US008834893B2

(12) United States Patent
Wakita et al.

(10) Patent No.: US 8,834,893 B2
(45) Date of Patent: Sep. 16, 2014

(54) NUCLEIC ACID DERIVED FROM HEPATITIS C VIRUS AND EXPRESSION VECTOR, TRANSFORMED CELL, AND HEPATITIS C VIRUS PARTICLES EACH PREPARED BY USING THE SAME

(75) Inventors: Takaji Wakita, Tokyo (JP); Tomoko Date, Kanagawa (JP); Hitoshi Takahashi, Kanagawa (JP)

(73) Assignees: Toray Industries, Inc., Tokyo (JP); Japan as Represented by Director-General of National Institute of Infectious Diseases, Tokyo (JP); Tokyo Metropolitan Institute of Medical Science, Tokyo (JP)

( * ) Notice: Subject to any disclaimer, the term of this patent is extended or adjusted under 35 U.S.C. 154(b) by 60 days.

(21) Appl. No.: 13/142,227

(22) PCT Filed: Dec. 25, 2009

(86) PCT No.: PCT/JP2009/071644
§ 371 (c)(1),
(2), (4) Date: Jun. 24, 2011

(87) PCT Pub. No.: WO2010/074249
PCT Pub. Date: Jul. 1, 2010

(65) Prior Publication Data
US 2012/0003720 A1    Jan. 5, 2012

(30) Foreign Application Priority Data
Dec. 26, 2008    (JP) ................................ 2008-335016

(51) Int. Cl.
| | | |
|---|---|---|
| C12N 15/00 | (2006.01) | |
| C12N 15/11 | (2006.01) | |
| C12N 15/33 | (2006.01) | |
| C12N 15/51 | (2006.01) | |
| C12N 7/00 | (2006.01) | |
| C07K 14/005 | (2006.01) | |
| A61K 39/00 | (2006.01) | |

(52) U.S. Cl.
CPC ............... *C07K 14/005* (2013.01); *C12N 7/00* (2013.01); *C12N 2770/24221* (2013.01); *C12N 2770/24251* (2013.01); *C12N 2770/24222* (2013.01); *A61K 2039/525* (2013.01)
USPC .................. 424/228.1; 424/204.1; 424/205.1; 424/225.1; 435/5; 435/320.1; 435/455; 435/243; 435/252.3

(58) Field of Classification Search
None
See application file for complete search history.

(56) References Cited

U.S. PATENT DOCUMENTS

| | | |
|---|---|---|
| 2006/0228697 A1 | 10/2006 | Grobler et al. |
| 2008/0220019 A1 | 9/2008 | Wakita et al. |
| 2009/0035747 A1 | 2/2009 | Wakita et al. |

FOREIGN PATENT DOCUMENTS

| | | |
|---|---|---|
| WO | WO 2004/074507 A2 | 9/2004 |
| WO | WO 2005/028652 A1 | 3/2005 |
| WO | WO 2005/080575 A1 | 9/2005 |

OTHER PUBLICATIONS

Paredes et al. A genetic interation between hepatitis C virus NS4B and NS3 is important for RNA replication. Journal of Virology, Nov. 2008, vol. 82, No. 21, p. 10671-10683.*
International Search Report for PCT/JP2009/071644, mailed on Feb. 9, 2010.
K. Abe et al., "Analysis of adaptive mutations in NS3 region inducing efficient replication of full-length HCV RNA", The 54th Annual Meeting of the Japanese Society for Virology, Nov. 1, 2006, vol. 54, p. 255.
K. Blight et al., "Efficient Initiation of HCV RNA Replication in Cell Culture", Science, Dec. 8, 2000, vol. 290, pp. 1972-1974.
K. Blight et al., "Highly Permissive Cell Lines for Subgenomic and Genomic Hepatitis C Virus RNA Replication", Journal of Virology, Dec. 2002, vol. 76, No. 24, pp. 13001-13014.
M. Ikeda et al., "Efficient replication of a full-length hepatitis C virus genome, strain O, in cell culture, and development of a luciferase reporter system", Biochemical and Biophysical Research Communications, 2005, vol. 329, pp. 1350-1359.
N. Krieger et al., "Enhancement of Hepatitis C Virus RNA Replication by Cell Culture-Adaptive Mutations", Journal of Virology, May 2001, vol. 75, No. 10, pp. 4614-4624.
T. Fukuma et al., "Mutations in the Interferon-Sensitivity Determining Region of Hepatitis C Virus and Transcriptional Activity of the Nonstructural Region 5A Protein", Hepatology, Oct. 1998, vol. 28, No. 4, pp. 1147-1153.
V. Lohmann et al., "Mutations in Hepatitis C Virus RNAs Conferring Cell Culture Adaptation", Journal of Virology, Feb. 2001, vol. 75, No. 3, pp. 1437-1449.
Extended European Search Report, dated Aug. 19, 2013, for Patent Application No. 09835045.7.
Kato et al., "Efficient Replication of the Genotype 2a Hepatitis C Virus Subgenomic Replicon" Gastroenterology, vol. 125, 2003, pp. 1808-1817, XP-005313661.

(Continued)

*Primary Examiner* — Louise Humphrey
(74) *Attorney, Agent, or Firm* — Birch, Stewart, Kolasch & Birch, LLP

(57) ABSTRACT

The present invention provides a nucleic acid comprises a 5' untranslated region, an NS3 protein coding region, an NS4A protein coding region, an NS4B protein coding region, an NS5A protein coding region, an NS5B protein coding region, and a 3' untranslated region of a hepatitis C virus genome, wherein the nucleic acid has nucleotide substitutions causing one or more amino acid substitutions selected from the group consisting of M(1205)K, F(1548)L, C(1615)W, T(1652)N, A(2196)T, A(2218)S, H(2223)Q, Q(2281)R, K(2520)N, and G(2374)S, as defined using the amino acid sequence shown in SEQ ID NO: 6 in the Sequence Listing as a reference sequence, in the NS3 protein coding region, the NS5A protein coding region, or the NS5B protein coding region.

19 Claims, 12 Drawing Sheets

(56) References Cited

OTHER PUBLICATIONS

Figure 1:
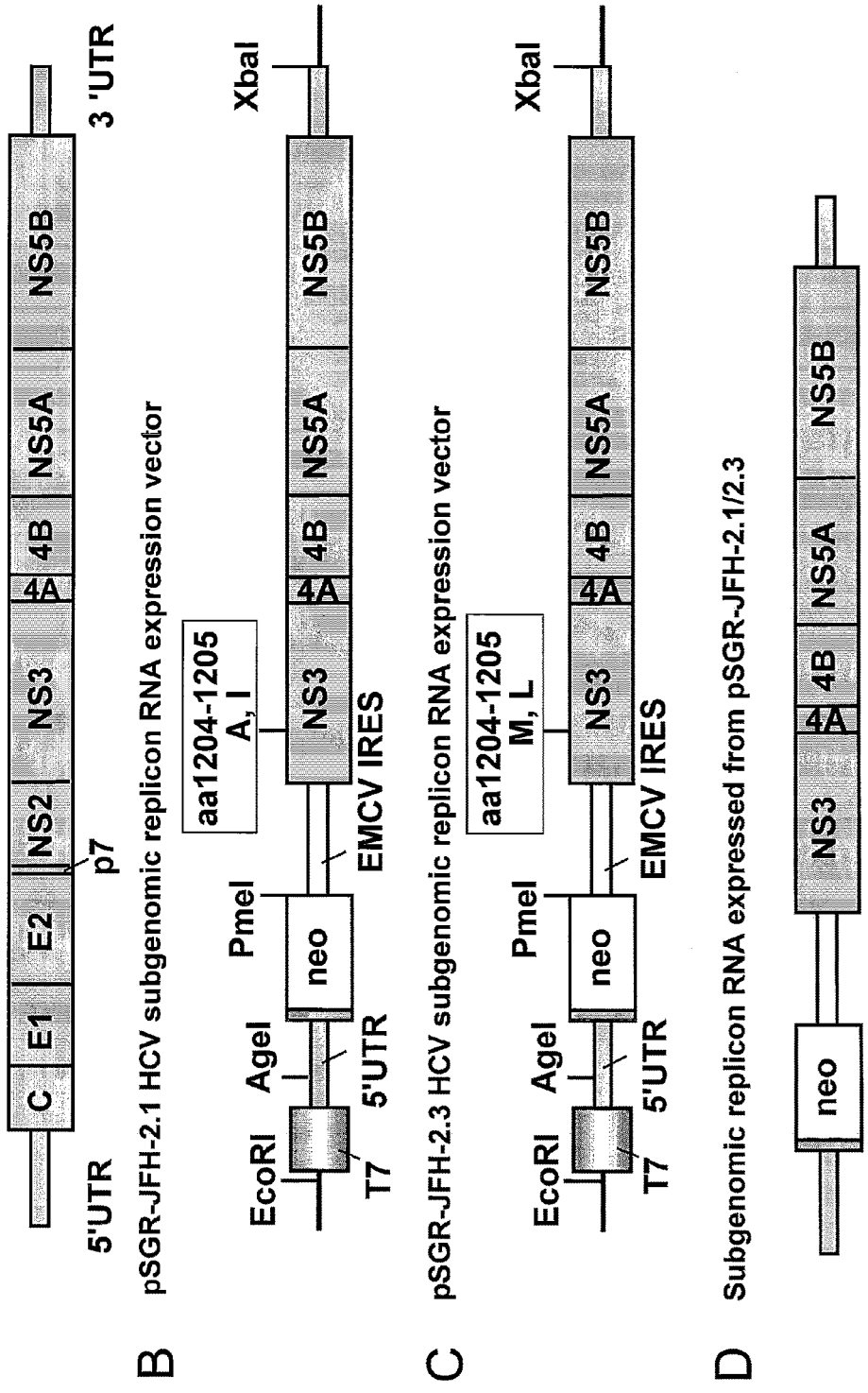

Japanese Office Action for Japanese Application No. 2010-544168, dated Feb. 12, 2014.

Lindenbach et al., "Complete Replication of Hepatitis C Virus in Cell Culture," Science, vol. 309, Jul. 22, 2005, pp. 623-626.

* cited by examiner

Fig. 2
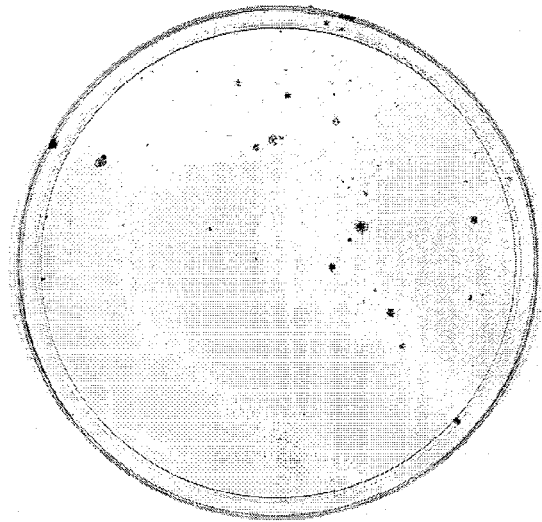
JFH-2.1
(aa1204-1205: AI)
1μg RNA
Colony formation +
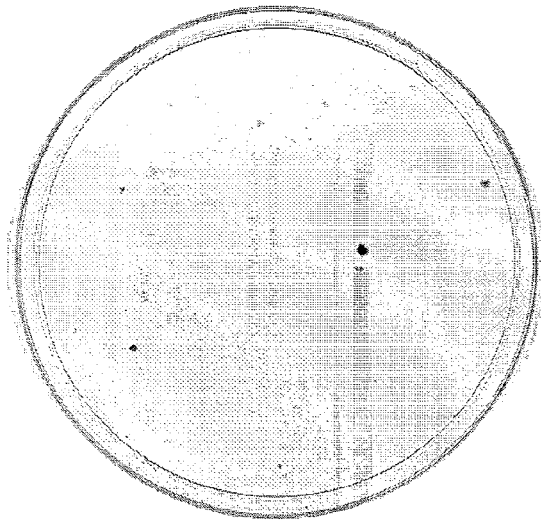
JFH-2.3
(aa1204-1205: ML)
1μg RNA
++

Fig. 5
A 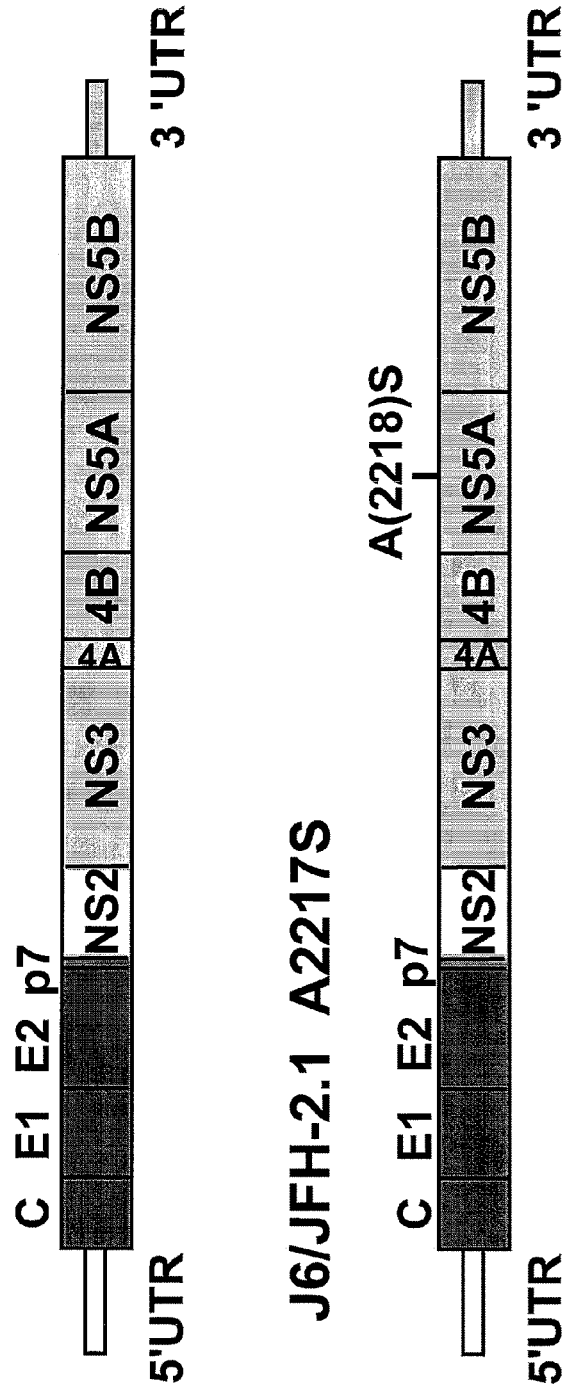
B 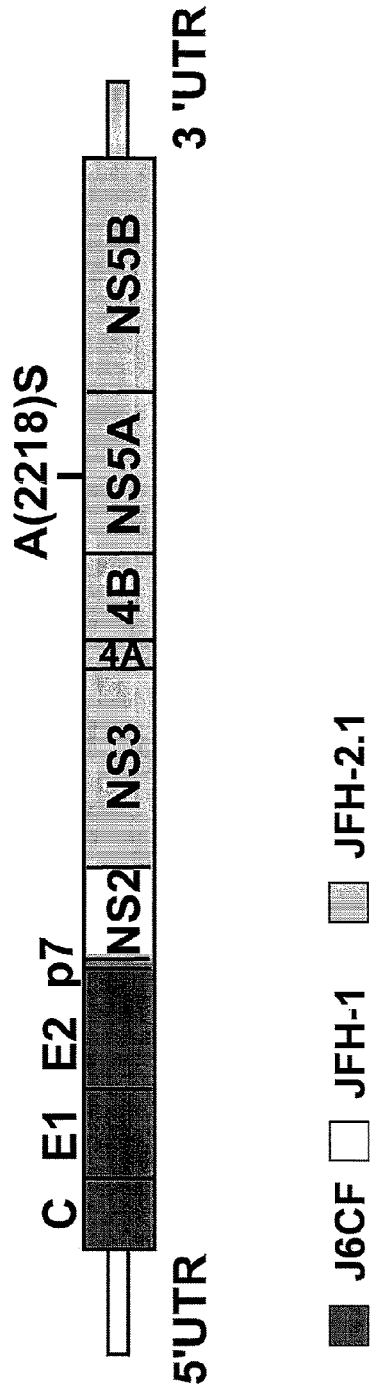

Fig. 8

| | Infectious titer | HCV Core | Infectious titer /Core |
|---|---|---|---|
| J6/JFH-2.1 A2217S 88 day | 5.21E+03 | 3.96E+03 | 1.32 |
| | (ffu/ml) | (fmol/L) | |

Fig. 11

| | Infectious titer | HCV Core | Infectious titer /Core |
|---|---|---|---|
| JFH-2.1 A2218S 63 day | 4.32E+04 | 1.17E+04 | 3.69 |
| | (ffu/ml) | (fmol/L) | |

NUCLEIC ACID DERIVED FROM HEPATITIS C VIRUS AND EXPRESSION VECTOR, TRANSFORMED CELL, AND HEPATITIS C VIRUS PARTICLES EACH PREPARED BY USING THE SAME

TECHNICAL FIELD

The present invention relates to hepatitis C virus-derived nucleic acids and expression vectors, transformed cells, and hepatitis C virus (HCV) particles prepared using the nucleic acids.

BACKGROUND ART

An experimental system that enables efficient virus amplification is essential for viral research and research and development of antiviral drugs. Moreover, if a system for amplifying a virus using cultured cells or a system for evaluating viral growth using cultured cells exists, viral research and research and development regarding antiviral drugs will be drastically advanced.

The hepatitis C virus (hereinafter, HCV) belongs to the family Flaviviridae, comprising single-stranded (+) sense RNA as its genome, and is known to cause hepatitis C. Recent studies have revealed that the hepatitis C virus is classified into many types depending on genotype or serotype. According to Simmonds et al's phylogenetic analysis method using the nucleotide sequences of the HCV strains, HCV is classified into 6 genotypes, and the genotypes are further classified into several subtypes (Simmonds, P. et al, Hepatology, 1994, 10: 1321-1324). The nucleotide sequences of the full-length genomes of a plurality of HCV genotypes have now been determined (Choo et al., Science, 1989, 244: 359-362; Kato et al., J. Med. Virol., 2001, 64: 334-339; Okamoto, H et al., J. Gen Virol., 1992, 73: 673-679; and Yoshioka et al., Hepatology, 1992, 16: 293-299).

Until recently, infection of cultured cells with HCV or replication of the HCV genome in cultured cells had been impossible. Hence, research into the HCV replication mechanism or the HCV infection mechanism has required experiments using an in vivo system using chimpanzees as experimental animals. However, preparation of subgenomic replicon RNA from the Con1 strain, the N strain, and the O strain of HCV of genotype 1b, as well as the H77 strain of HCV of genotype 1a has made it possible to conduct experiments on research into the HCV replication mechanism in an in vitro system using cultured cells (JP Patent Publication (Kokai) No. 2001-17187 A; Lomann et al., Science, 1999, 285: 110-113; Blight et al., Science, 2000, 290: 1972-1974; Friebe et al., 2001, 75: 12047-12057; and Ikeda et al., J. Virol., 2002, 76: 2997-3006). Here, the term "HCV subgenomic replicon RNA" refers to RNA comprising a part of the HCV genome, which is incapable of producing infectious HCV particles but capable of self-replication of HCV genome-derived RNA introduced into cells.

Furthermore, together with subgenomic replicon RNA, full-genomic replicon RNA, by which infectious HCV particles are produced by in vitro introduction into Huh7 cells, has been prepared from the JFH-1 strain of HCV of genotype 2a. This has made it possible to conduct an experiment with an in vitro system using cultured cells also for research into the HCV infection mechanism (Kato, T et al., Gastroenterology, 2003, 125: 1808-1817; and Wakita, T et al., Nat. Med., 2005, 11: 791-796). Here, the term "HCV full-genomic replicon RNA" refers to RNA comprising a full-length HCV genome, which is capable of self-replication of HCV genome-derived RNA introduced into cells and is capable of producing infectious HCV particles.

Meanwhile, hepatitis C is currently treated mainly by single-agent therapy with interferon-α or interferon-β and combination therapy with interferon-α and ribavirin, which is a purine-nucleoside derivative. However, it is known that even when these therapies are carried out, therapeutic effects are observed for only about 60% of all treated patients. It is also known that the disease flares up again among half or more of effectively treated patients if the therapies are discontinued. Also, the therapeutic effects of interferons are associated with HCV genotypes and thus are known to be low for genotype 1b but high for genotype 2a (Mori, S., et al., Biochem. Biophis. Res. Commun., 1992, 183: 334-342).

The reasons why the therapeutic effects of interferons differ depending on HCV genotype have not yet been clarified. One of the reasons is thought to be the presence of differences in HCV replication mechanism or HCV replication efficiency.

However, the presence of the HCV subgenomic replicon RNA is limited to several types from the HCV strains of genotypes 1a, 1b, and 2a. Moreover, the presence of full-genomic replicon RNA is limited to one type from the JFH-1 strain of HCV of genotype 2a. Hence, elucidation of the relationship between HCV genotype and HCV replication mechanism or HCV replication efficiency has been difficult. Also, the types of viral particles that can be artificially prepared and used for raw materials of HCV vaccines are also limited to those generated from the full-genomic replicon RNA. Thus, the finding of other subgenomic replicon RNAs or full-genomic replicons RNA of HCV with a characteristic replication mechanism or replication efficiency has been desired.

Subgenomic replicon RNAs or full-genomic replicon RNAs from HCV of the same genotype or from the same HCV strain having different characteristics in terms of replication mechanism or replication efficiency have been absent. Hence, differences in HCV replication mechanism or HCV replication efficiency could not have been compared using samples with the same genetic background. Furthermore, factors required for replication of HCV targeted by a new anti-HCV therapeutic agent could not have been identified and an anti-HCV therapeutic agent capable of exerting beneficial effects independently from the replication mechanism or the replication efficiency could not have been screened for.

DISCLOSURE OF THE INVENTION

Problem to be Solved by the Invention

An object of the present invention is to provide new HCV subgenomic replicon RNA and full-genomic replicon RNA with high self-replication capacity.

Means for Solving the Problem

The present inventors have introduced subgenomic replicon RNA prepared from an HCV genome isolated from a fulminant hepatitis C patient into cultured cells and then intensively studied mutations generated in the subgenomic replicon RNA that has self-replicated. Thus, they have revealed a mutation that significantly increases self-replication capacity (autonomous replication capacity). Furthermore, they have succeeded in preparation of full-genomic replicon RNA capable of producing infectious HCV particles by ligating regions and the like encoding structural protein of the HCV genome to HCV subgenomic replicon RNA having the mutation that significantly increases self-replication capacity. Thus, they have completed the present invention.

Specifically, the present invention provides a nucleic acid, comprising a 5' untranslated region, an NS3 protein coding region, an NS4A protein coding region, an NS4B protein coding region, an NS5A protein coding region, an NS5B protein coding region, and a 3' untranslated region of a hepatitis C virus genome, wherein the nucleic acid has nucleotide substitutions causing one or more amino acid substitutions selected from the group consisting of M(1205)K, F(1548)L, C(1615)W, T(1652)N, A(2196)T, A(2218)S, H(2223)Q, Q(2281)R, K(2520)N, and G(2374)S, as defined using the amino acid sequence shown in SEQ ID NO: 6 in the Sequence Listing as a reference sequence, in the NS3 protein coding region, the NS5A protein coding region, or the NS5B protein coding region.

The nucleic acid preferably has, at least, a nucleotide substitution causing amino acid substitution A(2218)S in the NS5A protein coding region.

The nucleic acid preferably further comprising a Core protein coding region, an E1 protein coding region, an E2 protein coding region, a p7 protein coding region, and an NS2 protein coding region of a hepatitis C virus genome.

In a preferred embodiment, the nucleic acid encodes an amino acid sequence having one or more amino acid substitutions selected from the group consisting of M(1205)K, F(1548)L, C(1615)W, T(1652)N, A(2196)T, A(2218)S, H(2223)Q, Q(2281)R, K(2520)N, and G(2374)S, as defined using the amino acid sequence shown in SEQ ID NO: 6 in the Sequence Listing as a reference sequence, in the amino acid sequence shown in SEQ ID NO: 5 or 6 in the Sequence Listing.

In another preferred embodiment, the nucleic acid consists of the nucleotide sequence shown in SEQ ID NO: 12 or 13 in the Sequence Listing.

The nucleic acid may further comprise a marker gene and/or an IRES sequence.

The nucleic acid may be a subgenomic replicon RNA.

Alternatively, the nucleic acid may be a full-genomic replicon RNA.

The nucleic acid comprising an HCV subgenomic sequence is useful as a template for synthesis of HCV subgenomic replicon RNA or directly as HCV subgenomic replicon RNA. HCV subgenomic replicon RNA is introduced into cultured cells, so that self-replication capacity higher than that of HCV subgenomic replicon RNA obtained thus far is exhibited. Accordingly, the nucleic acid comprising an HCV subgenomic sequence can be used for screening for an anti-HCV drug that inhibits HCV replication or for studies for elucidating HCV replication mechanism.

The nucleic acid comprising an HCV full-genomic sequence is useful as a template for synthesis of HCV full-genomic replicon RNA or directly as HCV full-genomic replicon RNA. HCV full-genomic replicon RNA is introduced into cultured cells, so that self-replication capacity higher than that of HCV full-genomic replicon RNA obtained so far is exhibited and infectious HCV particles can be efficiently produced.

The present invention further provides an expression vector comprising the nucleic acid that is operably ligated downstream of a promoter.

The present invention may further provide an expression vector comprising a nucleic acid that is operably ligated downstream of a promoter and encodes the full-genomic replicon RNA.

The present invention also provides a transformed cell that is obtained by introducing the full-genomic replicon RNA or an expression vector comprising a nucleic acid encoding the full-genomic replicon RNA. In such transformed cells, preferably, the full-genomic replicon RNA is self-replicating. Such transformed cells can be appropriately used for the production of hepatitis C virus (HCV) particles. Hepatitis C virus (HCV) particles obtained by culturing the transformed cells are further provided according to the present invention. The present invention also provides antibodies against such hepatitis C virus (HCV) particles.

This description includes the disclosure of the description and drawings of Japanese Patent Application No. 2008-335016, from which the present application claims priority.

Effects of the Invention

According to the present invention, HCV subgenomic replicon RNA and HCV full-genomic replicon RNA having high self-replication capacity can be provided. Such replicon RNA can be used for screening for an anti-HCV drug inhibiting HCV replication or for studies for elucidating HCV replication mechanism. Moreover, the HCV full-genomic replicon RNA of the present invention has HCV particle-producing capacity higher than that of HCV full-genomic replicon RNA obtained so far. Hence, infectious HCV particles can be prepared in vitro in large amounts. The thus obtained HCV particles can be used as HCV vaccines or antigens for preparation of anti-HCV antibodies.

BRIEF DESCRIPTION OF THE DRAWINGS

FIG. 1A shows the full-length genome structure of the HCV JFH-2.1 strain and JFH-2.3 strain. FIGS. 1B and C show the structures of vectors pSGR-JFH-2.1 and pSGR-JFH-2.3 for synthesis of HCV subgenomic replicon RNA from the JFH-2.1 and JFH-2.3 strains. FIG. 1D shows the structure of an HCV subgenomic replicon RNA from the JFH-2.1 and JFH-2.3 strains.

FIG. 2 shows photos showing colony formation by cells into which HCV subgenomic replicon RNA from the JFH-2.1 and the JFH-2.3 strains were introduced.

FIG. 3 shows amino acid mutations found in mutant replicons, which took place in cells into which the JFH-2.3 subgenomic replicon RNA had been introduced.

FIG. 4 shows the mutant JFH-2.1 HCV subgenomic replicon RNA (FIG. 4A) into which the amino acid substitutions found in the JFH-2.3 subgenomic replicon were introduced and photos showing colony formation by cells transformed with each of them (FIG. 4B).

FIG. 5 shows the structures of J6/JFH-2.1 and J6/JFH-2.1 A2217S chimeric HCV full-genomic replicon RNAs.

FIG. 6 shows changes over time in Core protein level in Huh7 cells into which the J6/JFH-2.1 and J6/JFH-2.1 A2217S chimeric HCV full -genomic replicon RNAs were introduced.

FIG. 7 shows changes over time in Core protein level in culture supernatants resulting from subculture of Huh7 cells into which the J6/JFH-2.1 A2217S chimeric HCV full-genomic replicon RNA was introduced.

FIG. 8 shows the result of evaluating the infectivity of J6/JFH-2.1 A2217S HCV particles.

FIG. 9 shows the structures of the JFII-2.1 genome RNA (HCV full-genomic replicon RNA) and the JFH-2.1 A2218S HCV full-genomic replicon RNA.

FIG. 10 shows changes over time in Core protein level in culture supernatants resulting from subculture of Huh7 cells into which the JFH-2.1 A2218S HCV full-genomic replicon RNA was introduced.

FIG. 11 shows the result of evaluating the infectivity of JFH-2.1 A2218S HCV particles.

Figure 12:
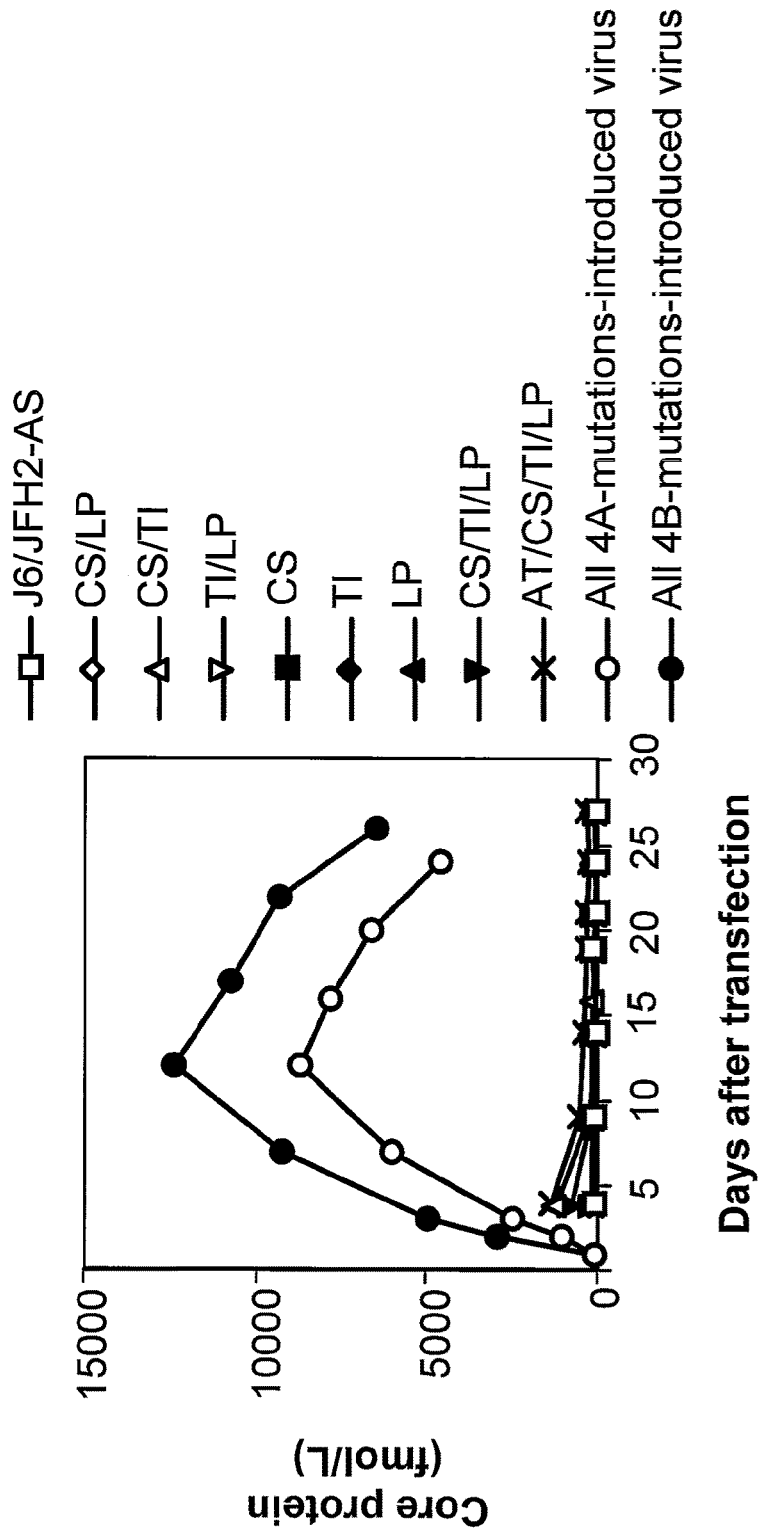

FIG. 12 shows changes over time in Core protein level in culture supernatants resulting from subculture of Huh7 cells (Huh7.5.1 cells) transfected with J6/JFH-2.1 A2217S-derived mutant HCV RNA. In FIG. 12, J6/JFH2-AS, CS, LP, TI, CS/LP, CS/TI, TI/LP, CS/TI/LP, AT/CS/TI/LP, all-4A-mutations-introduced virus, and all-4B-mutations-introduced virus denote J6/JFH-2.1 A2217S, J6/JFH-2.1 A2217S(CS), J6/JFH-2.1 A2217S (LP), J6/JFH-2.1 A2217S (TI), J6/JFH-2.1 A2217S(CS/LP), J6/JFH-2.1 A2217S(CS/TI), J6/JFH-2.1 A2217S (TI/LP), J6/JFH-2.1 A2217S(CS/TI/LP), J6/JFH-2.1 A2217S (AT/CS/TI/LP), J6/JFH-2.1 A2217S (TI/MT/MK/NT/IV/SG/TA), and J6/JFH-2.1 A2217S (AT/CS/TI/LP/MV/VG/IV/KR), respectively. The results for J6/JFH-2.1 A2217S (TI/MT/MK/NT/IV/SG/TA) are shown with open circles and the results for J6/JFH-2.1 A2217S (AT/CS/TI/LP/MV/VG/IV/KR) are shown with solid circles.

EMBODIMENTS FOR CARRYING OUT THE INVENTION (1) Mutant HCV Replicon RNA and Nucleic Acid Encoding the RNA According to the Present Invention The hepatitis C virus (HCV) genome is a single-stranded (+) RNA comprising approximately 9,600 nucleotides. This genomic RNA comprises a 5'-untranslated region (also referred to as "5' UTR" or "5' NTR"), a translational region composed of a structural region and a nonstructural region, and a 3'-untranslated region (also referred to as "3' UTR" or "3' NTR"). In the structural region, HCV structural proteins are encoded and in the nonstructural region, nonstructural proteins are encoded.

HCV structural proteins and nonstructural proteins are first transcribed and translated as a continuous precursor protein (polyprotein) from the translational region. HCV structural proteins are subjected to limited degradation by protease in host cells and nonstructural protein portions are subjected to limited degradation by 2 types of autocatalytically acting HCV protease activity, and then these proteins are separately released as mature proteins.

HCV structural proteins are Core, E1, E2, and p7, composing an HCV viral particle part. Core is a Core protein, E1 and E2 are envelope proteins, and p7 is a protein that forms an ion channel functioning on the membranes of host cells.

HCV nonstructural proteins are NS2, NS3, NS4A, NS4B, NS5A, and NS5B, which are enzyme proteins having activity involved in viral genome replication or HCV protein processing. Various HCV genotypes are known and HCV genomes of various genotypes are known to have similar gene structures.

The HCV 5' untranslated region (5' UTR or 5' NTR) provides an internal ribosome-entry site (IRES) for protein translation and elements required for replication, comprising about 340 nucleotides from the N-terminus of the full-length HCV genome.

HCV 3' untranslated region (3' UTR or 3' NTR) has functions of helping HCV replication and comprises an additional region of about 100 nucleotides, in addition to a poly U region.

With the use of the HCV genome, the present invention provides RNA that is self-replicable with high efficiency or DNA that encodes the RNA, comprising an HCV subgenomic sequence or the HCV full-genomic sequence into which a mutation has been introduced to increase self-replication capacity.

The term "replicon RNA" in the present invention refers to RNA that is self-replicable (autonomously replicable) in cells. Replicon RNA introduced into cells self-replicates and the resulting RNA copies are distributed to daughter cells after cell division, so that stable introduction into cells is possible using replicon RNA. In the present invention, the term "genotype" in the context of HCV refers to a genotype that is classified according to the International Classification developed by Simmonds et al.

In a preferred embodiment, the present invention provides a nucleic acid comprising a 5' untranslated region, an NS3 protein coding region, an NS4A protein coding region, an NS4B protein coding region, an NS5A protein coding region, an NS5B protein coding region, and a 3' untranslated region of a hepatitis C virus genome, wherein the nucleic acid has nucleotide substitutions that cause one or more amino acid substitutions selected from the group consisting of M(1205)K, F(1548)L, C(1615)W, T(1652)N, A(2196)T, A(2218)S, H(2223)Q, Q(2281)R, K(2520)N, and G(2374)S, as defined using the amino acid sequence shown in SEQ ID NO: 6 in the Sequence Listing as a reference sequence, in the NS3 protein coding region, the NS5A protein coding region, or the NS5B protein coding region. Such a nucleic acid is typically mutant HCV replicon RNA or DNA encoding the mutant RNA.

The nucleic acid according to the present invention is a nucleic acid that comprises a 5' untranslated region, an NS3 protein coding region, an NS4A protein coding region, an NS4B protein coding region, an NS5A protein coding region, an NS5B protein coding region, and a 3' untranslated region of a hepatitis C virus genome and encodes an amino acid sequence comprising at least the NS3 protein, the NS5A protein, or the NS5B protein in which one or more amino acid substitutions selected from the group consisting of M(1205)K, F(1548)L, C(1615)W, T(1652)N, A(2196)T, A(2218)S, H(2223)Q, Q(2281)R, K(2520)N, and G(2374)S, as defined using the amino acid sequence shown in SEQ ID NO: 6 in the Sequence Listing as a reference sequence.

The term "nucleic acid" as used herein refers to, in addition to RNA and DNA, a hybrid nucleic acid formed via binding thereof. Also, herein, the term "protein coding region" refers to a nucleotide sequence encoding the amino acid sequence of a given protein, which may or may not comprise an initiation codon and a termination codon.

In the Description, the expression "amino acid substitution $a(Z)_b$" as defined using the amino acid sequence shown in SEQ ID NO: "X" in the Sequence Listing as a reference sequence" means that an amino acid in a given amino acid sequence Y to be aligned with amino acid "a" located at position "Z" in the amino acid sequence shown in SEQ ID NO: "X", which is, but not limited to, preferably amino acid "a" that is the same as in SEQ ID NO: "X" or an amino acid analogous to amino acid "a", is substituted with amino acid "b", when the amino acid sequence Y (preferably, homologous to SEQ ID NO: "X") is aligned with the sequence shown in SEQ ID NO: "X" in the Sequence Listing as a reference sequence. Here, "a" and "b" represent given amino acids, which are each described based on single letter notation generally used for amino acids in the field of biology.

Thus, for example, the expression "amino acid substitution A(2218)S as defined using the amino acid sequence shown in SEQ ID NO: 6 in the Sequence Listing as a reference sequence," means a substitution of S (serine) for an amino acid in a given amino acid sequence Y to be aligned with the amino acid A (alanine) at position 2218 of SEQ ID NO: 6 when the amino acid sequence "Y" of a HCV precursor protein is aligned with the amino acid sequence shown in SEQ ID NO: 6 (the amino acid sequence of the precursor protein of the HCV JFH-2.3 strain). Therefore, when the $2217^{th}$ alanine (alanine at position 2217) in the amino acid sequence of an entire HCV precursor protein is aligned with the alanine at position 2218 in the amino acid sequence shown in SEQ ID NO: 6, for example, substitution of alanine at position 2217 with serine in the amino acid sequence of interest corresponds to "amino acid substitution A(2218)S as defined using the amino acid sequence shown in SEQ ID NO: 6 in the Sequence Listing as a reference sequence."

Also, the phrase "amino acid at position "Z" as defined using the amino acid sequence shown in SEQ ID NO: "X" in the Sequence Listing as a reference sequence" refers to an amino acid in a given amino acid sequence Y to be aligned with the amino acid at position "Z" in the amino acid sequence shown in SEQ ID NO: "X" when the sequence shown in SEQ ID NO: "X" is aligned with the sequence Y (preferably, homologous to SEQ ID NO: "X"). The expression "nucleotide at position "Z" as defined using the nucleotide sequence shown in SEQ ID NO: "X" in the Sequence Listing as a reference sequence" will be also similarly understood.

In the Description, if a nucleic acid is RNA and the nucleotide sequence or nucleotides of RNA are specified by referring to SEQ ID NO(S) in the Sequence Listing, "T (thymine)" in the nucleotide sequence shown in the relevant SEQ ID NO should be read as "U (uracil)."

Alignment of a given sequence Y with the sequence shown in SEQ ID NO: "X" can be manually carried out, or by the Clustal W multiple alignment program (Thompson, J. D. et al, (1994) Nucleic Acids Res. 22, p. 4673-4680) using default setting, for example.

In the Description, each HCV region can also be identified with the nucleotide positions at the 5' terminus and the 3' terminus of each region, as defined using the nucleotide sequence shown in SEQ ID NO: 4 (the full-length genome sequence of the JFH-2.3 strain) as a reference sequence. In the nucleotide sequence shown in SEQ ID NO: 4, 5' UTR ranges from nucleotide positions 1 to 340, the Core coding region (Core region) ranges from nucleotide positions 341 to 913, the E1 coding region (E1 region) ranges from nucleotide positions 914 to 1492, the E2 coding region (E2 region) ranges from nucleotide positions 1493 to 2593, the p7 coding region (p7 region) ranges from nucleotide positions 2594 to 2782, the NS2 coding region (NS2 region) ranges from nucleotide positions 2783 to 3433, the NS3 coding region (NS3 region) ranges from nucleotide positions 3434 to 5326, the NS4A coding region (NS4A region) ranges from nucleotide positions 5327 to 5488, the NS4B coding region (NS4B region) ranges from nucleotide positions 5489 to 6271, the NS5A coding region (NS5A region) ranges from nucleotide positions 6272 to 7669, the NS5B coding region (NS5B region) ranges from nucleotide positions 7670 to 9445, and 3' UTR ranges from nucleotide positions 9446 to 9686.

In the Description, an amino acid in an HCV precursor protein can be specified with an amino acid number that is given by numbering with the translation initiation methionine (M) of the precursor protein being numbered as the "1st" amino acid. For example, the precursor protein of the JFH-2.1 strain begins from the translation initiation methionine and then terminates at the 3034$^{th}$ arginine (R). In addition, the 2218$^{th}$ amino acid of the JFH-2.1 strain is alanine (A) comprised in the NS5A region.

In the Description, an amino acid substitution is denoted by, A(2218)S, or A→S at position 2218, for example. Specifically, as a rule, both of them mean that A (alanine) at position 2218 is substituted with S (serine). In the Description, amino acids or amino acid residues are described by single letter codes or three letter codes that are generally employed for amino acids in the field of biology (Sambrook et al., Molecular Cloning: A Laboratory Manual Second Edition, 1989). The amino acids as denoted above also include amino acids subjected to post-translational modification such as hydroxylation, glycosylation, or sulfation.

In the present invention, one or more amino acid substitutions selected from the group consisting of M(1205)K, F(1548)L, C(1615)W, T(1652)N, A(2196)T, A(2218)S, H(2223)Q, Q(2281)R, K(2520)N, and G(2374)S as defined using the amino acid sequence shown in SEQ ID NO: 6 in the Sequence Listing as a reference sequence are introduced into the NS3 protein, the NS5A protein, and the NS5B protein in an HCV precursor protein, so that the self-replication capacity of the replicon RNA encoding the HCV precursor protein can be increased. Such introduction of an amino acid substitution(s) can be carried out by introducing a nucleotide substitution that causes the relevant amino acid substitution into DNA encoding HCV replicon RNA using genetic engineering techniques known by persons skilled in the art.

A nucleotide substitution(s) that causes the above amino acid substitution(s) can be easily specified by comparing a codon of the amino acid after substitution with a codon of the amino acid before substitution, in light of the genetic code table well-known in the field of biology.

The nucleic acid according to the present invention such as mutant HCV replicon RNA or DNA encoding the RNA is not limited, but preferably has a nucleotide substitution that causes at least amino acid substitution A(2218)S from among the above amino acid substitutions. This is because the amino acid substitution is particularly effective for enhancing self-replication. For example, a nucleotide substitution that causes amino acid substitution A(2218)S is preferably a nucleotide substitution that converts codons encoding alanine at amino acid position 2218 (in general, GCT, GCC, GCA, or GCG) into codons encoding serine, such as TCA, TCC, TCG, TCT, AGT, or AGC.

The nucleic acid according to the present invention, such as mutant HCV replicon RNA or DNA encoding the RNA, may further comprise a Core protein coding region, an E1 protein coding region, an E2 protein coding region, and a p7 protein coding region of a hepatitis C virus genome, in addition to the 5' untranslated region, the NS3 protein coding region, the NS4A protein coding region, the NS4B protein coding region, the NS5A protein coding region, the NS5B protein coding region, and the 3' untranslated region. The mutant HCV replicon RNA according to the present invention or a nucleic acid encoding the RNA may further comprise an NS2 protein coding region of a hepatitis C virus genome. The mutant HCV replicon RNA according to the present invention or a nucleic acid encoding the RNA further preferably comprises the Core protein coding region, the E1 protein coding region, the E2 protein coding region, the p7 protein coding region, and the NS2 protein coding region, and more preferably comprises the same in this order.

A preferable example of the nucleic acid according to the present invention is a nucleic acid encoding an amino acid sequence with one or more amino acid substitutions selected from the group consisting of M(1205)K, F(1548)L, C(1615) W, T(1652)N, A(2196)T, A(2218)S, H(2223)Q, Q(2281)R, K(2520)N, and G(2374)S, as defined using the amino acid sequence shown in SEQ ID NO: 6 in the Sequence Listing as a reference sequence, in the amino acid sequence shown in SEQ ID NO: 5 or 6 in the Sequence Listing. The nucleic acid encodes a mutant of the precursor protein of the JFH-2.1 strain (SEQ ID NO: 5) or the JFH-2.3 strain (SEQ ID NO: 6) isolated from a fulminant hepatitis patient.

Another preferable example of the above nucleic acid according to the present invention is a nucleic acid comprising the nucleotide sequence shown in SEQ ID NO: 12 or 13 in the Sequence Listing.

The nucleic acid according to the present invention such as mutant HCV replicon RNA or DNA encoding the RNA preferably further comprises a foreign gene such as a marker gene and/or an IRES sequence. Examples of such a marker gene includes a selection marker gene that can impart selectivity to cells by which only cells expressing the relevant gene are selected and a reporter gene encoding a gene product serving as an index of the gene expression. In the present invention, preferable examples of such a selection marker gene include, but are not limited to, a neomycin resistance gene, a thymidine kinase gene, a kanamycin resistance gene, a pyrithiamine resistance gene, an adenylyl transferase gene, a Zeocin resistance gene, and a puromycin resistance gene. In the present invention, preferable examples of a reporter gene include, but are not limited to, a transposon Tn9-derived chloramphenicol acetyltransferase gene, an *Escherichia coli*-derived β glucuronidase or β galactosidase gene, a luciferase gene, a green fluorescent protein gene, a jellyfish-derived aequorin gene, and a secreted placental alkaline phosphatase (SEAP) gene.

The term "IRES sequence" in the present invention refers to an internal ribosome-entry site capable of causing a ribosome to bind internally to RNA so as to initiate translation. Preferable examples of such an IRES sequence in the present invention include, but are not limited to, EMCV IRES (internal ribosome-entry site of encephalomyocarditis virus), FMDV IRES, and HCV IRES.

The nucleic acid according to the present invention, such as mutant HCV replicon RNA or DNA encoding the RNA may be a nucleic acid comprising an HCV subgenomic replicon sequence which comprises, as an HCV-derived sequence, only a 5' untranslated region, an NS3 protein coding region, an NS4A protein coding region, an NS4B protein coding region, an NS5A protein coding region, an NS5B protein coding region, and a 3' untranslated region of the hepatitis C virus genome. In the present invention, the term "HCV subgenome" refers to a partial sequence of the HCV full-length genome. HCV subgenomic replicon RNA is replicon RNA that comprises an HCV subgenome, but comprises not all regions ranging from 5' UTR to 3' UTR of the HCV full-length genome.

An example of a nucleic acid comprising an HCV subgenomic replicon sequence is RNA wherein, in the 5' to 3' direction, 5' UTR, a sequence comprising 36 nucleotides from the 5' terminus of a Core coding region, a luciferase gene (marker gene), an encephalomyocarditis virus IRES sequence, an NS3 region, an NS4A region, an NS4B region, an NS5A region, an NS5B region, and 3' UTR are ligated in this order, for example.

The nucleic acid according to the present invention such as mutant HCV replicon RNA or DNA encoding the RNA may also be HCV full-genomic replicon RNA. The term "HCV full-genomic replicon RNA" refers to replicon RNA comprising all regions ranging from 5' UTR to 3' UTR of the HCV full-length genome, specifically, 5' UTR, a Core protein coding region (Core region), an E1 protein coding region (E1 region), an E2 protein coding region (E2 region), a p7 protein coding region (p7 region), an NS2 protein coding region (NS2 region), an NS3 protein coding region (NS3 region), an NS4A protein coding region (NS4A region), an NS4B protein coding region (NS4B region), an NS5A protein coding region (NS5A region), an NS5B protein coding region (NS5B region), and 3' UTR. HCV full-genomic replicon RNA may consist of the HCV full-length genome sequence or may further comprise an additional sequence. In the present invention, the term "HCV full-length genome" or "full-length HCV genome" refers to RNA comprising the full-length sequence (ranging from 5' UTR to 3' UTR) of the HCV genome or DNA encoding the RNA.

(2) Preparation of Replicon RNA According to the Present Invention

The mutant HCV replicon RNA according to the present invention, specifically, the mutant HCV subgenomic replicon RNA or the mutant HCV full-genomic replicon RNA can be prepared by preparing a replicon RNA expression vector by any genetic engineering technique known by persons skilled in the art using DNA encoding the mutant HCV replicon RNA and then using it as a template. The present invention also provides a vector and particularly an expression vector comprising a nucleic acid (preferably, DNA encoding mutant HCV replicon RNA) such as mutant HCV replicon RNA, DNA encoding the RNA, or the like, which is operably ligated downstream of a promoter. The expression vector can be used to efficiently synthesize in vitro the mutant HCV replicon RNA. Basic techniques for construction of the replicon RNA expression vector according to the present invention are as described in the document of Lohmann et al. (Science, 285: 110-113, 1999) and the document of Kato et al. (Gastroenterology, 125: 1808-1817, 2003).

As an HCV strain that can be used for preparation of the nucleic acid according to the present invention, any strain isolated from an HCV patient or a derivative strain thereof can be used. An HCV strain isolated from a fulminant hepatitis C patient is more preferably used. A method for isolation of the HCV genome from a patient is as described in the document of Kato et al (Gastroenterology, 125: 1808-1817, 2003). In the present invention, the term "derivative strain" in the context of HCV refers to a strain derived from a viral strain of interest.

The genome of any hepatitis C virus strain can be used for preparation of the nucleic acid according to the present invention. At least one genome of hepatitis C virus of genotype 2a is preferably used. Regions encoding the NS3 protein, the NS4A protein, the NS4B protein, the NS5A protein, and the NS5B protein may be derived from any hepatitis C virus genome. More preferably, such regions from the genome of hepatitis C virus of genotype 2a are used. Further preferably, a sequence from the genome of the HCV JFH-2.1 or HCV JFH-2.3 strain, a derivative strain of the strains, or the HCV JFH-1 strain, into which the above amino acid substitution(s) is introduced, is used.

The nucleic acid according to the present invention may be a chimera from the genome of one, two, or more types of arbitrary hepatitis C virus. The nucleic acid according to the present invention may be, but is not limited to, a chimera in which at least one genome of hepatitis C virus of genotype 2a is used. For preparation of the nucleic acid according to the present invention, the genome of the HCV JFH-1 strain, J6CF strain, HCV JFH-2.1 strain, HCV JFH-2.3 strain, or a derivative strain of these strains can be used, for example.

The mutant HCV replicon RNA according to the present invention can be prepared by the following method, for example, but the method is not limited thereto. First, DNA encoding the above mutant HCV replicon RNA is ligated by a conventional method downstream of an RNA promoter in a vector, so that a DNA clone is prepared. Examples of an RNA promoter include, but are not limited to, a T7 promoter, an SP6 promoter, and a T3 promoter. A T7 promoter is particularly preferable. As a vector, pUC19 (TaKaRa), pBR322 (TaKaRa), pGEM-3Z (Promega), pSP72 (Promega), pCRII (Invitrogen), pT7Blue (Novagen), or the like can be used, but the examples are not limited to them.

Preparation (synthesis) of mutant HCV replicon RNA from an expression vector comprising DNA encoding the mutant HCV replicon RNA can be carried out using a MEGA script T7 kit (Ambion) or the like, for example. Furthermore, when a vector is introduced into cells for expression, a vector comprising RNA polymerase I promoter and terminator (described in WO2007-037428 (HCV#9)) is preferably used.

The thus prepared mutant HCV replicon RNA may be extracted and purified by an RNA extraction method, purification method, or the like known by persons skilled in the art.

(3) Preparation of Transformed Cells Comprising Self-Replicating Mutant HCV Replicon RNA The above-prepared replicon RNA such as mutant HCV replicon RNA is introduced into host cells, so that transformed cells comprising self-replicating replicon RNA can be obtained. The present invention also provides transformed cells obtained via introduction of mutant HCV replicon RNA into the cells, in which the replicon RNA self-replicates.

Cells into which replicon RNA is introduced may be any cells that enable HCV replicon replication. Such cells are more preferably human liver-derived cells, human uterine cervix-derived cells or human embryonic kidney-derived cells. Examples of such cells include Huh7 cells, HepG2 cells, IMY-N9 cells, HeLa cells, and 293 cells. Further appropriate examples of such cells include derivative strains of Huh7 cells such as Huh7.5 cells and Huh7.5.1 cells. Also, cells such as Huh7 cells, HepG2 cells, IMY-N9 cells, HeLa cells or 293 cells, in which a CD81 gene and/or a Claudin 1 gene is expressed, are also examples of such cells. Of these cells, Huh7 cells or derivative cells of Huh7 cells are preferably used.

Replicon RNA can be introduced into cells using any technique known by persons skilled in the art. Examples of such a technique include calcium phosphate coprecipitation, a DEAE dextran method, lipofection, microinjection, and electroporation. Preferably, lipofection and electroporation are carried out. More preferably, a method based on electroporation is particularly preferably carried out.

Regarding replicon RNA, target replicon RNA alone may be introduced or target replicon RNA mixed with another nucleic acid may also be introduced. To vary the amount of replicon RNA while keeping the amount of RNA to be introduced at a constant level, target replicon RNA is mixed with total cellular RNA extracted from cells to be used for introduction and then the mixture is introduced into the cells. The amount of replicon RNA to be introduced into cells may be determined depending on an introduction method to be employed. The amount of replicon RNA to be used herein ranges from preferably 1 picogram to 100 micrograms and more preferably 10 picograms to 10 micrograms.

When replicon RNA comprising a marker gene is used, cells in which replicon RNA has been introduced and is self-replicating can be selected using the expression of the marker gene.

Viable cells can be cloned by a conventional method from colonies formed after introduction into cells and culturing the cells. In such a manner, cell clones comprising self-replicating replicon RNA can be established.

The thus established cell clones are preferably actually confirmed for self-replication of replicon RNA by detecting the replication of replicon RNA from the introduced replicon RNA in the cells, confirming the expression of a marker gene in replicon RNA, or confirming the expression of an HCV protein (e.g., Core), for example. Expression of an HCV protein can be confirmed by reacting an antibody against an HCV protein to be expressed from the introduced replicon RNA with a protein extracted from cell clones. This method can be carried out by any protein detection method known by persons skilled in the art. Specifically, for example, the method can be carried out by blotting a protein sample extracted from cell clones to nitrocellulose membrane, reacting an anti-HCV protein antibody (e.g., an anti-Core-specific antibody or antiserum collected from a hepatitis C patient) with the membrane, and then detecting the anti-HCV protein antibody. If an HCV protein is detected from proteins extracted from cell clones, it can be concluded that HCV-derived replicon RNA self-replicates and the HCV protein is expressed in the cell clones. The thus established and preferably confirmed cell clones are transformed cells obtained by introduction of the replicon RNA according to the present invention.

As a method for evaluation of the replication capacity of replicon RNA in transformed cells, the functions of a foreign gene ligated into HCV subgenomic replicon RNA or HCV full-genomic replicon RNA can be measured. When a foreign gene is a drug resistance gene, evaluation can be made by determining the number of cells or the number of colonies of cells that grow in drug-containing selective medium. Also, when a foreign gene is an enzyme gene, replication capacity can be evaluated by measuring the enzyme activity. As another method, replication capacity can be evaluated by quantitatively determining the amount of RNA replicated by quantitative PCR.

It has been demonstrated that efficient replication of an HCV genome requires the occurrence of mutation in the nucleotide sequence of the HCV genome (Lohmann, V. et al., J. Virol., 75: 1437-1449, 2001). Mutation that improves replication is referred to as adaptive mutation. The mutant HCV replicon RNA according to the present invention is replicon RNA with significantly enhanced self-replication. Through continuation of culture, adaptive mutation takes place in HCV replicon RNA and replication may be significantly improved. Amino acid substitution A(2218)S, as defined using the amino acid sequence shown in SEQ ID NO: 6 in the Sequence Listing as a reference sequence leads to such significant enhancement in replication capacity.

(4) Production of Infectious HCV Particles

In the present invention, transformed cells obtained by introduction of the HCV replicon RNA according to the present invention are subcultured, so that infectious HCV particles can be produced and preferably released into medium. Herein, the HCV replicon RNA according to the present invention is a replicon RNA that comprises an HCV structural region in addition to a 5' untranslated region, sequences encoding an NS3 protein, an NS4A protein, an NS4B protein, an NS5A protein, and an NS5B protein, respectively, and a 3' untranslated region of a hepatitis C virus genome. Specifically, the HCV replicon RNA is:

a nucleic acid that further comprises a Core protein coding region, an E1 protein coding region, an E2 protein coding region, and a p7 protein coding region of the hepatitis C virus genome in addition to a 5' untranslated region, sequences encoding an NS3 protein, an NS4A protein, an NS4B protein, an NS5A protein, and an NS5B protein, respectively, and a 3' untranslated region of a hepatitis C virus genome;

a nucleic acid (HCV full-genomic replicon RNA) that further comprises a Core protein coding region, an E1 protein coding region, an E2 protein coding region, a p7 protein coding region, and an NS2 protein coding region in addition to a 5' untranslated region, sequences encoding an NS3 protein, an NS4A protein, an NS4B protein, an NS5A protein, and an NS5B protein, respectively, and a 3' untranslated region of a hepatitis C virus genome; or a nucleic acid that comprises the nucleotide sequence shown in SEQ ID NO: 12 or 13 in the Sequence Listing, or a nucleic acid that comprises a nucleotide sequence encoding an amino acid sequence with one or more amino acid substitutions selected from the group consisting of M(1205)K, F(1548)L, C(1615)W, T(1652)N, A(2195)T, A(2218)S, H(2223)Q, Q(2281)R, K(2520)N, and G(2374)S, as defined using the amino acid sequence shown in SEQ ID NO: 6 in the Sequence Listing as a reference sequence, in the amino acid sequence shown in SEQ ID NO: 5 or 6 in the Sequence Listing.

Typical examples of the transformed cells according to the present invention capable of producing infectious HCV particles include full-length chimeric replicon RNA and transformed cells into which such a full-length chimeric replicon RNA has been introduced, wherein the full-length chimeric replicon RNA comprises the JFH-1 strain-derived 5' untranslated region; the J6CF strain-derived Core protein coding region, E1 protein coding region, E2 protein coding region, and p7 protein coding region; the JFH-1 strain-derived NS2 protein coding region; and furthermore, a nucleotide sequence encoding an amino acid sequence wherein one or more and preferably any one of the above amino acid substitutions have been introduced into the HCV JFH-2.1 strain- or HCV JFH-2.3 strain-derived NS3 protein coding region, NS4A protein coding region, NS4B protein coding region, NS5A protein coding region, NS5B protein coding region, and 3' untranslated region.

The viral particle-producing capacity of such transformed cells can also be detected using antibodies against HCV proteins (e.g., a Core protein, an E1 protein, or an E2 protein) composing HCV viral particles released into medium (culture solution). Also, the presence of HCV viral particles can also be indirectly detected by amplifying and detecting HCV replicon RNA contained in HCV viral particles in a culture solution by RT-PCR using specific primers.

HCV particles produced by the above transformed cells are infectious to cells (preferably, HCV-sensitive cells). In the present invention, the term "HCV-sensitive cells" refers to cells that are infected with HCV. Such HCV-sensitive cells are preferably hepatic cells or lymphoid lineage cells, but the examples are not limited to them. Specific examples of hepatic cells include primary hepatic cells, Huh7 cells, HepG2 cells, IMY-N9 cells, HeLa cells, and 293 cells. Specific examples of lymphoid lineage cells include Molt4 cells, HPB-Ma cells, and Daudi cells. However, the examples are not limited to these cells.

Whether or not the prepared HCV particles are infectious can be determined by treating HCV permissive cells (e.g., Huh-7) using a culture supernatant obtained by culturing the above transformed cells (into which HCV replicon RNA has been introduced), immunostaining the cells after a given time period (e.g., after 48 hours) with an anti-Core antibody, and then determining the number of infected cells. Alternatively, determination can be made by subjecting a cell extract to electrophoresis on SDS-polyacrylamide gel, detecting the Core protein by Western blotting, and thus detecting infected cells.

The present invention also relates to a method for preparing HCV particles by culturing the above transformed cells capable of producing infectious HCV particles and then preferably obtaining (e.g., collecting a culture supernatant) HCV particles released into medium (preferably, culture solution).

The present invention provides HCV particles obtained by the method and preferably infectious HCV particles. The HCV particles also infect HCV-sensitive animals such as chimpanzees, so as to be able to induce HCV-derived hepatitis.

(5) Use of Subgenomic Replicon RNA

Transformed cells into which the HCV subgenomic replicon RNA according to the present invention has been introduced can be used for screening for a compound that inhibits the replication of the HCV subgenomic replicon RNA.

More specifically, for example, RNA in which, in the 5' to 3' direction, 5' UTR, a sequence ranging from the 5' terminus to nucleotide 36 of a Core coding region, a luciferase gene (marker gene), an encephalomyocarditis virus IRES sequence, an NS3 region, an NS4A region, an NS4B region, an NS5A region, and an NS5B region, and 3' UTR are ligated in this order is introduced into Huh7 cells. Subsequently, the cells are treated with a compound to be screened. After 48 to 72 hours, luciferase activity is measured. A compound that suppresses luciferase activity compared with a group not treated with the compound is considered to have effects of suppressing the replication of the HCV subgenomic replicon RNA. Accordingly, it can also be determined that which compound may have the activity of suppressing replication on HCV of the same genotype as that of an HCV strain from which the replicon RNA or particularly the NS3-to-NS5B regions are derived or on HCV that is observed in a patient or the like with an HCV-related disease from which the relevant HCV strain has been isolated.

(6) Use of HCV Particles

The HCV particles of the present invention can also be used for screening for an antibody or a compound inhibiting HCV infection.

The HCV particles according to the present invention are also preferably used as vaccines or antigens for preparation of anti-HCV antibodies.

Specifically, the HCV particles according to the present invention can be used as vaccines without modification. The HCV particles can also be attenuated or inactivated via a method known in the art and then used. The virus can be inactivated by adding and mixing an inactivator such as formalin, β-propiolactone, or glutardialdehyde with, for example, a virus suspension and allowing the inactivator to react with the virus (Appaiahgari, M. B. & Vrati, S., Vaccine, 22: 3669-3675, 2004).

The vaccine can be formulated into a dosage form that can be administered, such as a solution or suspension. The vaccine can be prepared in a solid state that is suitable for dissolution or suspension it in a solution. Alternatively, such a preparation can be emulsified or encapsulated in liposomes.

Active immunogenic ingredients, such as HCV particles, are often mixed with excipients that are pharmaceutically acceptable and compatible with the active ingredients to be used herein. Examples of adequate excipients include water, physiological saline, dextrose, glycerol, ethanol, and a mixture thereof. Further, the vaccine can contain a minor amount of an auxiliary agent (e.g., a humidifier or an emulsifier), a pH buffer, and/or an adjuvant that enhances vaccine efficacy. Examples of the effective adjuvant include, but are not limited to, aluminum hydroxide, N-acetyl-muramyl-L-threonyl-D-isoglutamine (thr-MDP), N-acetyl-nor-muramyl-L-alanyl-D-isoglutamine (referred to as CGP11637, nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (referred to as CGP19835A, MTP-PE), and RIBI. RIBI comprises three components extracted from bacteria; i.e. monophosphoryl lipid A, trehalose dimycolate, and a cell wall skeleton (HPL+TDM+CWS), in 2% squalene/Tween®

80 emulsion. Effects of an adjuvant can be determined by measuring the amount of antibodies resulting from administration of a vaccine comprising HCV particles.

The vaccine is generally administered parenterally, by injection such as subcutaneous injection or intramuscular injection, for example. Examples of other formulations that are suitable as other forms of dosage include suppositories and oral preparations.

One or more compounds having adjuvant activity can be added to an HCV vaccine. An adjuvant is a non-specific stimulant to the immune system. Such substance enhances the immune response of a host against HCV vaccines. Specific examples of adjuvants that are known in the art include Freund's complete and incomplete adjuvants, vitamin E, a nonionic block polymer, muramyl dipeptide, saponin, mineral oil, vegetable oil, and Carbopol. Examples of adjuvants particularly suitable for transmucosal administration include *E. coli* heat-labile toxin (LT) and cholera toxin (CT). Examples of other adequate adjuvants include aluminum hydroxide, aluminum phosphate or aluminum oxide, an oil emulsion (e.g., Bayol® or Marcol 5®), saponin, and a vitamin E solubilizate. Accordingly, the vaccine of a preferable embodiment of the present invention comprises an adjuvant.

Concerning an injectable solution for subcutaneous, intracutaneous, intramuscular, or intravenous administration, other specific examples of a pharmaceutically acceptable carrier or diluent that is used for administration in combination with the HCV vaccine of the present invention in the injectable solution include a stabilizer, a carbohydrate (e.g., sorbitol, mannitol, starch, sucrose, glucose, or dextran), a protein (e.g., albumin or casein), a protein-containing substance (e.g., bovine serum or skimmed milk), and buffer (e.g., phosphate buffer).

Examples of conventional binders and carriers that are used for suppositories can include polyalkylene glycol and triglyceride. Such a suppository can be prepared from a mixture comprising 0.5% to 50%, and preferably 1% to 20% active ingredients. Oral preparations comprise excipients that are generally used. Examples of excipients include mannitol, lactose, starch, magnesium stearate, saccharin sodium, cellulose, and magnesium carbonate of pharmaceutical grade.

The vaccine of the present invention can be in the form of a solution, suspension, tablet, pill, capsule, sustained-release preparation, or powder, and its active ingredients (viral particles or a part thereof) account for 10% to 95%, and preferably 25% to 70% thereof.

The vaccine of the present invention is administered in a manner suitable for a dosage form and in an amount that can exert preventive and/or therapeutic effects. The amount to be administered generally ranges from 0.01 µg to 100,000 µg of an antigen per dose. Such amount varies depending on the patient to be treated, the capacity of the patient for antibody synthesis in the immune system, and the desired degree of protection. Also, the amount varies depending on the route of administration, such as oral, subcutaneous, intracutaneous, intramuscular, or intravenous administration.

The vaccine of the present invention can be administered according to a single-administration schedule, and preferably according to a multiple-administration schedule. In the case of a multiple-administration schedule, 1 to 10 separate administrations are performed at the time of initiation of vaccine inoculation, and another administration can then be performed with a time interval that is necessary for maintaining or enhancing the immune response. For example, the second administration can be performed 1 to 4 months after the first. Where needed, administration may be subsequently performed several months after the first. The administration regimen is, at least partially, determined according to the needs of individual patient, and the regimen depends on the judgment made by a doctor.

Further, the vaccine comprising the HCV particles of the present invention may be administered with another immunological agent (e.g., immunoglobulin).

Further, the HCV particle vaccine of the present invention can be used preventively against possible new HCV infection via administration to healthy individuals to induce immune response to HCV. The HCV particle vaccine of the present invention can also be used as a therapeutic vaccine to induce strong immune response to HCV in vivo to eliminate HCV via administration to patients infected with HCV, via administration to patients infected with HCV.

The HCV particles of the present invention are also useful as antigens to be used for preparing anti-HCV antibodies. HCV particles to be used as antigens desirably have higher purity. Cells or cell debris are removed from a culture solution containing HCV particles by centrifugation and/or using a filter or the like. Such a solution from which cell debris has been removed can also be concentrated about 10- to 100-fold using ultrafiltration membrane having a molecular weight cut off ranging from 100,000 to 500,000. Such a solution containing HCV particles, from which cell debris has been removed, can be purified by chromatography (e.g., gel filtration chromatography, ion exchange chromatography, and affinity chromatography) and density-gradient centrifugation in combination in any order or alone.

(7) Antibodies Against HCV Particles

The present invention also provides antibodies against HCV particles obtained in (4) above. Preferable examples of such an antibody include particularly antibodies against HCV particles having the structural proteins (Core, E1, E2, and p7) of the JFH-2.1 or JFH-2.3 strain. More specifically, examples of antibodies against HCV particles having the structural proteins (Core, E1, E2, and p7) of the JFH-2.3 strain are antibodies against HCV particles produced by transformed cells that are obtained by introducing the HCV replicon RNA encoding: the amino acid sequence ranging from amino acid positions 1 to 191 of SEQ ID NO: 6 in the Sequence Listing as a Core protein; the amino acid sequence ranging from amino acid positions 192 to 384 of the same as an E1 protein; the amino acid sequence ranging from amino acid positions 385 to 751 of the same as an E2 protein; and the amino acid sequence ranging from amino acid positions 752 to 814 as a p7 protein.

Antibodies can be prepared by administering the HCV particles of the present invention to mammalians or birds. Examples of mammalians include mice, rats, rabbits, goats, sheep, horses, cattle, guinea pigs, dromedaries, bactrian camels, and lamas. Dromedaries, bactrian camels, and lamas are suitable for preparing an antibody consisting of the H chain alone. Examples of birds include chickens, geese and ostriches. The blood serum may be taken from an animal to which the HCV particles of the present invention have been administered and then antibodies can be obtained therefrom by well-known methods.

Hybridomas that produce monoclonal antibody-producing cells can be prepared with the use of cells of the animals immunized with the HCV particles of the present invention. Methods for producing hybridomas are well-known in the art, and the method described in, for example, Antibodies: A Laboratory Manual (Cold Spring Harbor Laboratory, 1988) can be employed.

Monoclonal antibody-producing cells may be prepared via cell fusion or via other methods involving introduction of DNA of a cancer gene or infection with Epstein-Barr virus for immortalization of B lymphocytes.

More specifically, procedures for preparing an anti-HCV monoclonal antibody by administering HCV particles to mice are as described below. Generally 4- to 10-week-old mice are immunized with HCV particles as antigens, but a purification step may be omitted if necessary. Immunization is generally carried out by administering an antigen several times subcutaneously or intraperitoneally with an adjuvant. Examples of such an adjuvant include, but are not limited to, Freund's complete and incomplete adjuvants, aluminium hydroxide gel, *Hemophilus* pertussis vaccine, Titer Max Gold (Vaxel), and GERBU adjuvant (GERBU Biotechnik). Final immunization is carried out by administering HCV particles intravenously or intraperitoneally without administering any adjuvant. On days 3 to 10 after the final immunization with HCV particles and preferably on day 4, the spleen was excised from an immunized mouse according to a known method (Antibodies: A Laboratory Manual Cold Spring Harbor Laboratory, 1988).

A method that is employed herein involves preparation of spleen cells from the spleen and fusion of spleen cells to myeloma cells, so as to prepare hybridoma cells producing a monoclonal antibody. As myeloma cells to be used for cell fusion, any myeloma cells may be used, as long as they are replicable in vitro. Examples of such myeloma cells include mouse-derived established cell lines such as 8-azaguanine resistant mouse (BALB/c-derived) myeloma cell lines (e.g., P3-X63Ag8-U1(P3-U1), SP2/0-Ag14(SP2/0), P3-X63-Ag8653(653), P3-X63-Ag8(X63), and P3/NS1/1-Ag4-1 (NS1)). These cell lines are available from the RIKEN BioResource Center, ATCC (American Type Culture Collection), or ECACC (European Collection of Cell Cultures). Culture and subculture are carried out according to known methods (Antibodies: A Laboratory Manual Cold Spring Harbor Laboratory, 1988, Selected Methods in Cellular Immunology W.H. Freeman and Company, 1980).

The thus obtained spleen cells and myeloma cells are washed and then mixed at a ratio of 1 (myeloma cells): 1-10 (spleen cells), followed by cell fusion reaction. As a fusion accelerator, polyethylene glycol, polyvinyl alcohol, or the like with an average molecular weight ranging from 1000 to 6000 can be used. Also, cells can also be fused using a commercially available cell fusion apparatus using electrical stimulation (e.g., electroporation).

After cell fusion, cells are suspended in medium and then washed. Cells are washed using medium used for culturing myeloma cells, such as Dulbecco's modified Eagle's medium or RPMI-1640 medium. Medium for culturing fused cells is supplemented with a HAT supplement in order to selectively obtain only target fused cells. Limiting dilution (after dilution to $10^3$ to $10^7$ cells/ml, cells are seeded into a 96-well cell culture microplate at $10^2$ to $10^6$ cells/well) or cloning is carried out by a colony formation method in methylcellulose medium.

Hybridomas can be screened for by a general method and the method is not particularly limited. For example, a portion of the culture supernatant is collected, the supernatant is added to an immobilized HCV protein, and then a labeled secondary antibody is added for incubation. The binding ability may be measured by enzyme-linked immunosorbent assay (ELISA) or radioimmunoassay (RIA) or subjected to dot blot analysis or western blot analysis. A hybridoma line confirmed to produce an antibody that reacts with a target antigen is selected as a hybridoma line producing a monoclonal antibody.

Moreover, hybridomas producing an anti-HCV monoclonal antibody having activity of inhibiting HCV infection can be selected by a method for measuring the activity of inhibiting HCV infection using infectious HCV particles as described in the following example.

First, infectious HCV particles (the method for preparing HCV particles is as described above) and an antibody sample are mixed and then allowed to react at 37° C. for 1 hour. The sample (50 µl) is added to Huh7 cells cultured on the day before mixing, in a 96-well plate at $5\times10^3$ cells/well and then cells are cultured at 37° C. for 2.5 hours. After culture, the sample is removed, cells are washed with PBS, fresh medium is added, and then cells are cultured continuously. After 48 hours, the culture supernatant is removed, the resultant is washed once with PBS, 100 µl of ISOGEN (Nippon Gene) is added, and then RNA is prepared from the cells. After quantification of RNA, the amount of HCV genomic RNA is measured. Detection of HCV RNA by quantitative RT-PCR is carried out by detecting the RNA of the 5' untranslated region of HCV RNA according to the method of Takeuchi et al. (Takeuchi T. et al., Gastroenterology, 116: 636-642, 1999).

Another method for evaluating the activity of inhibiting HCV infection is as follows. First, an antibody sample and infectious HCV particles are mixed and then allowed to react at 37° C. for 1 hour. Next, 50 µl of the above sample is added to Huh-7 cells cultured on the day before mixing in a 96-well plate at $1\times10^4$ cells/well and then cells are cultured at 37° C. for 2.5 hours. After culture, the sample is removed, cells are washed with PBS, fresh medium is added, and then cells are continuously cultured. After 72 hours, the culture supernatant is removed, and then the plate is placed in ice-cooled methanol, so that cells are immobilized. Subsequently, methanol is removed by air drying and then cells are solubilized using BlockAce® (Dainippon Pharmaceutical) containing 0.3% Triton®-X 100 (GE Healthcare). HCV-infected cells are counted under fluorescence microscopy (Olympus Corporation, IX-70) using a clone 2H9 anti-HCV-Core antibody (see Nat. Med. (2005) 11: p791-6.) and goat anti-mouse IgG-Alexa488 (Molecular Probes). Samples in wells in which HCV infection has been inhibited are confirmed to be positive clones, so that target hybridomas can be selected. A monoclonal antibody that is produced by hybridomas selected as described above is a preferred embodiment of the antibody of the present invention.

The monoclonal or polyclonal antibodies obtained by such techniques are useful for diagnosis, therapy, and prevention of HCV. If an antibody is from an animal, a chimeric antibody formed with a human antibody can be prepared. A particularly preferable chimeric antibody is a humanized antibody (human-type antibody) or the like prepared by transplanting the sequence of a hypervariable site of a mouse antibody into a human antibody. Such a humanized antibody is particularly useful for therapy or prevention of HCV.

The antibodies prepared with the use of the HCV particles of the present invention may be administered with pharmaceutically acceptable solubilizers, additives, stabilizers, buffers, or the like. Such antibodies may be administered via any route. Subcutaneous, intracutaneous, or intramuscular administration is preferable, and intravenous administration is more preferable.

The present invention can be performed using molecular biological and immunological techniques within the general technical scope of the relevant field. Such techniques are sufficiently explained in various documents including known experimental protocols and the like. For example, such techniques are described in detail in Sambrook et al., Molecular Cloning: A Laboratory Manual (vol. 3, 2001), Ed Harlow et al., Antibodies: A Laboratory Manual (1988).

(8) Short Time Production of HCV Viral Particles Using Mutant HCV RNA-Replicating Cells The nucleic acid according to the present invention, such as the mutant HCV replicon RNA or DNA encoding the mutant RNA, and preferably nucleic acids such as chimeric mutant HCV replicon RNAs derived from 2 or more HCV strains or DNAs encoding the RNAs may further comprise nucleotide substitutions that cause amino acid substitutions.

In an embodiment, a nucleic acid such as mutant HCV replicon RNA that is a chimera of the HCV J6 strain and the HCV JFH-2.1 strain or DNA encoding the RNA and preferably J6/JFH-2.1 A2217S RNA that is chimeric mutant HCV replicon RNA having the nucleotide sequence shown in SEQ ID NO: 12 or DNA encoding the RNA may comprise a nucleotide substitution that causes substitution of 1 or 2 or more amino acids and particularly preferably 7 or more amino acids. The amino acid substitutions may be, but is not limited to, at least 1, preferably 2 or more, further preferably 3 or 4 or more, and particularly preferably 7 or 8 amino acid substitutions selected from the group consisting of A→T at position 148 (Core region), M→V at position 356 (E1 region), M→K at position 405, N→T at position 417 and V→G at position 626 (E2 region), M→T at position 868 (NS2 region), T→A at position 1642 (NS3 region), I→V at position 1687 (NS4A region), I→V at position 1722 and K→R at position 1767 (NS4B region), S→G at position 2204 and C→S at position 2219 (NS5A region), T→I at position 2695 and L→P at position 3016 (NS5B region), as defined using the amino acid sequence (SEQ ID NO: 88) of the precursor protein encoded by J6/JFH-2.1 A2217S RNA as a reference sequence. For example, J6/JFH-2.1 A2217S RNA or DNA encoding the RNA may have nucleotide substitutions that cause 2 or more (preferably 3 or 4 or more), for example, or all the 7 amino acid substitutions selected from the group consisting of M→K at position 405, N→T at position 417, M→T at position 868, T→A at position 1642, I→V at position 1722, S→G at position 2204, and T→I at position 2695. Alternatively, J6/JFH-2.1 A2217S RNA or DNA encoding the RNA may have nucleotide substitutions that cause 2 or more (preferably 3 or 4 or more), for example, all the 8 amino acid substitutions selected from the group consisting of A→T at position 148, M→V at position 356, V→G at position 626, I→V at position 1687, K→R at position 1767, C→S at position 2219, T→I at position 2695, and L→P at position 3016. Cells, into which the RNA of a multiple mutant replicon having a nucleotide substitution that causes such an additional amino acid substitution (e.g., a mutant HCV replicon that is a chimera of the HCV J6 strain with the HCV JFH-2.1 strain or the JFH-2.3 strain) or DNA encoding the RNA has been introduced, initiate the production of viral particles relatively immediately after the initiation of replication, and then can stably produce viral particles in large amounts for dozens of days (e.g., 40 days). Therefore, if such a mutant replicon is used, viral particles can be produced in large amounts within a short period after the initiation of replication. The present invention also provides such advantageous multiple mutant HCV replicon RNA or DNA encoding the RNA. The present invention also provides an expression vector comprising the DNA that encodes the multiple mutant HCV replicon RNA and recombinant cells into which the vector has been introduced. The present invention also provides cells into which the multiple mutant replicon RNA has been introduced. As the cells according to the present invention, into which such a multiple mutant replicon is introduced, hepatic cell-derived cells or lymphoid lineage cells can be used, for example.

Examples of hepatic cell-derived cells include, but are not limited to, Huh7 cells, Huh7 cells, HepG2 cells, IMY-N9 cells, HeLa cells, and 293 cells. Examples of lymphoid lineage cells include, but are not limited to, Molt4 cells, HPB-Ma cells, and Daudi cells.

Cells into which the multiple mutant replicon has been introduced are cultured for a relatively short time period, so that viral particles can be efficiently produced in large amounts. The culture period may be 1 or more days, more preferably 2 or more days, even more preferably 3 or more days, further preferably 5 or more days, and particularly preferably 10 or more days from the initiation of culture, for example. The culture period may be 60 or less days, more preferably 50 or less days, even more preferably 40 or less days, further preferably 30 or less days, and particularly preferably 20 or less days from the initiation of culture. Whereas cells into which an HCV replicon has been introduced are generally known to tend to drastically decrease once their production amount of viral particles from the early to the middle periods after the initiation of replication, the cells according to the present invention into which the multiple mutant HCV replicon has been introduced is very advantageous in that they can stably produce viral particles in large amounts within a short time period. The present invention also provides a method for producing HCV viral particles using cells according to the present invention into which the multiple mutant replicon RNA or DNA encoding the RNA has been introduced.

(9) Summary of Sequences

In addition, sequences specified by SEQ ID NOS: in the present application are summarized as follows.

SEQ ID NO: 1: nucleotide sequence containing the portion ranging from T7 promoter to 3' UTR in recombinant plasmid pSGR-JFH-2.1

SEQ ID NO: 2: nucleotide sequence containing the portion ranging from T7 promoter to 3' UTR in recombinant plasmid pSGR-JFH-2.3

SEQ ID NO: 3: full-length genome sequence (nucleotide sequence encoding full-length genomic RNA) of the HCV JFH-2.1 strain SEQ ID NO: 4: full-length genome sequence (nucleotide sequence encoding full-length genomic RNA) of the HCV JFH-2.3 strain SEQ ID NO: 5: amino acid sequence of the precursor protein of the HCV JFH-2.1 strain SEQ ID NO: 6: amino acid sequence of the precursor protein of the HCV JFH-2.3 strain SEQ ID NO: 7: nucleotide sequence of the structural region (containing Core, E1, E2, and p7) of the HCV J6CF strain SEQ ID NO: 8: nucleotide sequence of 5' UTR of the HCV JFH-1 strain SEQ ID NO: 9: nucleotide sequence of the NS2 region of the HCV JFH-1 strain SEQ ID NO: 10: sequence ranging from the NS3 region to the 3' UTR (containing NS3, NS4A, NS4B, NS5A, and NS5B regions and 3' UTR) of the HCV JFH-2.1 strain SEQ ID NO: 11: nucleotide sequence of chimeric HCV genome sequence J6/JFH-2.1

SEQ ID NO: 12: nucleotide sequence of chimeric HCV genome sequence J6/JFH-2.1 A2217S SEQ ID NO: 13: nucleotide sequence of mutant HCV genome sequence JFH-2.1 A2218S SEQ ID NO: 14: amino acid sequence of the NS3-to-NS5B regions of the precursor protein of the HCV JFH-2.1 strain SEQ ID NO: 15: amino acid sequence of the NS3-to-NS5B regions of the precursor protein of the HCV JFH-2.3 strain SEQ ID NOS: 16-77: primers SEQ ID NO: 78: nucleotide sequence of mutant chimeric HCV genome sequence J6/JFH-2.1 A2217S(CS)

SEQ ID NO: 79: nucleotide sequence of mutant chimeric HCV genome sequence J6/JFH-2.1 A2217S (LP)

SEQ ID NO: 80: nucleotide sequence of mutant chimeric HCV genome sequence J6/JFH-2.1 A2217S (TI)

SEQ ID NO: 81: nucleotide sequence of mutant chimeric HCV genome sequence J6/JFH-2.1 A2217S(CS/LP)

SEQ ID NO: 82: nucleotide sequence of mutant chimeric HCV genome sequence J6/JFH-2.1 A2217S(CS/TI)

SEQ ID NO: 83: nucleotide sequence of mutant chimeric HCV genome sequence J6/JFH-2.1 A2217S (TI/LP)

SEQ ID NO: 84: nucleotide sequence of mutant chimeric HCV genome sequence J6/JFH-2.1 A2217S(CS/TI/LP)

SEQ ID NO: 85: nucleotide sequence of mutant chimeric HCV genome sequence J6/JFH-2.1 A2217S (AT/CS/TI/LP)

SEQ ID NO: 86: nucleotide sequence of mutant chimeric HCV genome sequence J6/JFH-2.1 A2217S (TI/MT/MK/NT/IV/SG/TA)

SEQ ID NO: 87: nucleotide sequence of mutant chimeric HCV genome sequence J6/JFH-2.1 A2217S (AT/CS/TI/LP/MV/VG/IV/KR)

SEQ ID NO: 88: amino acid sequence of the precursor protein encoded by J6/JFH-2.1 A2217S SEQ ID NO: 89: amino acid sequence of the precursor protein encoded by J6/JFH-2.1 A2217S(CS)

SEQ ID NO: 90: amino acid sequence of the precursor protein encoded by J6/JFH-2.1 A2217S (LP)

SEQ ID NO: 91: amino acid sequence of the precursor protein encoded by J6/JFH-2.1 A2217S (TI)

SEQ ID NO: 92: amino acid sequence of the precursor protein encoded by J6/JFH-2.1 A2217S(CS/LP)

SEQ ID NO: 93: amino acid sequence of the precursor protein encoded by J6/JFH-2.1 A2217S(CS/TI)

SEQ ID NO: 94: amino acid sequence of the precursor protein encoded by J6/JFH-2.1 A2217S (TI/LP)

SEQ ID NO: 95: amino acid sequence of the precursor protein encoded by J6/JFH-2.1 A2217S(CS/TI/LP)

SEQ ID NO: 96: amino acid sequence of the precursor protein encoded by J6/JFH-2.1 A2217S (AT/CS/TI/LP)

SEQ ID NO: 97: amino acid sequence of the precursor protein encoded by J6/JFH-2.1 A2217S (TI/MT/MK/NT/IV/SG/TA)

SEQ ID NO: 98: amino acid sequence of the precursor protein encoded by J6/JFH-2.1 A2217S (AT/CS/TI/LP/MV/VG/IV/KR)

All publications, patents, and patent applications cited herein are incorporated herein by reference in their entirety.

EXAMPLES

The present invention is further illustrated with reference to the following examples. However, these examples do not limit the technical scope of the present invention.

Example 1

Construction of JFH-2.1 Strain- and JFH-2.3 Strain-Derived HCV Subgenomic Replicon RNA Expression Vectors HCV subgenomic replicon RNA expression vectors, plasmid pSGR-JFH-2.1 and pSGR-JFH-2.3, were separately constructed using nonstructural region of the full-length genome clone DNA of the HCV JFH-2.1 strain and JFH-2.3 strain of genotype 2a isolated from fulminant hepatitis patients (FIG. 1) as follows. FIG. 1A shows the full-length genome structure of the HCV JFH-2.1 strain and JFH-2.3 strain.

Plasmids, pSGR-JFH-2.1 and pSGR-JFH-2.3, were constructed according to the procedures described in the document of Kato et al. (Gastroenterology, 125: 1808-1817, 2003) and WO05028652A1. Specifically, first, recombinant plasmids, pJFH-2.1 and pJFH-2.3, were provided, wherein cDNA encoding the full-length genome of the HCV JFH-2.1 strain or JFH-2.3 strain was inserted under control of a T7 promoter in a plasmid vector pUC19. Subsequently, structural region and portions of nonstructural region in recombinant plasmids, pJFH-2.1 and pJFH-2.3 were substituted with a neomycin resistance gene (neo; also referred to as neomycin phosphotransferase gene) and EMCV-IRES (encephalomyocarditis virus internal ribosome entry site). Cleavage was carried out with restriction enzymes to excise inserted fragments and then the fragments were cloned into recombinant vectors to separately construct plasmids, pSGR-JFH-2.1 and pSGR-JFH-2.3.

FIG. 1B and FIG. 1C show the structures of the plasmid vectors, pSGR-JFH-2.1 and pSGR-JFH-2.3. In FIG. 1B and FIG. 1C, "T7" denotes a T7 promoter. The T7 promoter is a sequence element required for expression of HCV subgenomic replicon RNA using T7 RNA polymerase from each plasmid vector. In the plasmid vectors, pSGR-JFH-2.1 and pSGR-JFH-2.3, 5' UTR, NS3-NS5B coding regions, and 3' UTR are sequences from the HCV JFH-2.1 or JFH-2.3 strain. Herein, "neo" denotes a neomycin resistance gene and "EMCV IRES" denotes an encephalomyocarditis virus internal ribosome-binding site. HCV subgenomic replicon RNA that is expressed from these vectors is RNA transcribed from regions downstream of the T7 promoter, as shown in FIG. 1D.

The nucleotide sequences consisting of a T7 promoter and the HCV subgenomic replicon RNA coding region ligated downstream thereof, in pSGR-JFH-2.1 and pSGR-JFH-2.3, are shown in SEQ ID NOS: 1 and 2, respectively.

In addition, the full-length genome sequences of the HCV JFH-2.1 strain and JFH-2.3 strain used herein are shown in SEQ ID NOS: 3 and 4, respectively. The amino acid sequences of virus precursor proteins (polyproteins) encoded by the full-length genome sequences of the HCV JFH-2.1 and JFH-2.3 strains are shown in SEQ ID NOS: 5 and 6, respectively. The amino acid sequence shown in SEQ ID NO: 5 is encoded by nucleotide positions 341 to 9445 (including termination codon) of the nucleotide sequence of SEQ ID NO: 3. The amino acid sequence shown in SEQ ID NO: 6 is encoded by nucleotide positions 341 to 9445 (including termination codon) of the nucleotide sequence of SEQ ID NO: 4. Also, the amino acid sequences of NS3-to-NS5B regions in precursor proteins of the HCV JFH-2.1 strain and JFH-2.3 strain are shown in SEQ ID NO: 14 and 15, respectively. The amino acid sequence of SEQ ID NO: 14 (NS3-NS5B regions) corresponds to amino acid positions 1032 to 3034 of SEQ ID NO: 5. Also, the amino acid sequence of SEQ ID NO: 15 (NS3-NS5B regions) corresponds to amino acid positions 1032 to 3034 of SEQ ID NO: 5. Here, as shown in FIG. 1B and FIG. 1C, whereas the sequence of amino acid positions 1205 to 1206 (in NS3 region) of the precursor protein (SEQ ID NO: 5) of the HCV JFH-2.1 strain is alanine (A)-isoleucine (I), the sequence of amino acid positions 1205 to 1206 (in NS3 region) of the precursor protein (SEQ ID NO: 6) of the HCV JFH-2.3 strain is methionine (M)-leucine(L).

Example 2

Preparation of HCV Subgenomic Replicon RNA

For preparation of HCV subgenomic replicon RNA, expression vectors, pSGR-JFH-2.1 and pSGR-JFH-2.3, constructed as described in Example 1 were each cleaved with restriction enzyme Xba I, thereby preparing template DNA for PCR. Subsequently, each of these Xba I cleavage fragments were incubated at 30° C. for 30 minutes after addition of Mung Bean Nuclease 20 U (total volume of reaction solution: 50 μl) to 10 μg to 20 μg of the template DNA for enzyme treatment. Mung Bean Nuclease is an enzyme that catalyzes a reaction of selectively degrading and blunt-ending the single-stranded portion of the double-stranded DNA. In general, when RNA transcription is carried out with RNA polymerase by directly using as a template the above Xba I cleavage fragment, a replicon RNA in which extra CUGA (4 nucleotides) corresponding to a portion of the Xba I recognition sequence has been added at the 3' terminus is synthesized. Hence, in this Example, the Xba I cleavage fragment was treated with Mung Bean Nuclease, so that 4 nucleotides of CUGA were removed from the Xba I cleavage fragment.

Next, the solution treated with Mung Bean Nuclease containing the Xba I cleavage fragment was subjected to protein removing treatment according to a conventional method to purify the Xba I cleavage fragment from which 4 nucleotides of CUGA had been removed for using as template DNA in the next reaction. From the template DNA, RNA was synthesized in vitro by T7 promoter-based transcription reaction using MEGAscript (Ambion). Specifically, 20 μl of a reaction solution containing 0.5 μg to 1.0 μg of the template DNA was prepared according to the manufacturer's instruction, followed by 3 to 16 hours of reaction at 37° C.

After completion of RNA synthesis, DNase (2U) was added to the reaction solution for 15 minutes of reaction at 37° C. to remove the template DNA. RNA extraction was further carried out using acid phenol, so that HCV subgenomic replicon RNAs transcribed from pSGR-JFH-2.1 and pSGR-JFH-2.3 were obtained.

Example 3

Establishment of HCV Subgenomic Replicon-Replicating Cell Clones

Each (1 μg) synthetic HCV subgenomic replicon RNA from the JFH-2.1 strain or the JFH-2.3 strain prepared in Example 2 was mixed with total cellular RNA extracted from Huh7 cells by a conventional method to adjust the total amount of RNA to 10 μg. Then, the mixed RNA was introduced into Huh7 cells by electroporation. The electroporated Huh7 cells were seeded on a culture dish and cultured for 16 to 24 hours, and then G418 (neomycin) was added to the culture dish. Then, the culture was continued while replacing the culture medium twice a week. After 21 days of culture following seeding, viable cells were stained with crystal violet. As a result, colony formation could be confirmed as shown in FIG. 2 for cells into which replicon RNA from either the JFH-2.1 or JFH-2.3 strain had been introduced. The colony formation indicated that a HCV subgenomic replicon RNA had been replicated in the cells.

Regarding the above replicon RNA-transfected cells for which colony formation was confirmed, colonies of viable cells were further cloned from the above culture dish after 21 days of the culture, and then the culture was continued. A plurality of cell clone strains could be established by such colony cloning These resulting cell clones were designated as JFH-2.1 subgenomic replicon cells and JFH-2.3 subgenomic replicon cells. It was considered that the introduced JFH-2.1 strain-derived subgenomic replicon RNA or JFH-2.3 strain-derived subgenomic replicon RNA self replicated in the thus established cell clones.

Example 4

Sequence Analysis of Replicon RNA in JFH-2.3 Subgenomic Replicon Cells

Sequence analysis was conducted for subgenomic replicon RNA present in JFH-2.3 subgenomic replicon cells established in Example 3. First, total RNA was extracted from the established 10 clones of JFH-2.3 subgenomic replicon cells and then HCV subgenomic replicon RNA contained therein was amplified by RT-PCR. For the amplification, 5'-TAATACGACTCACTATAG-3' (SEQ ID NO: 16) and 5'-GCGGCTCACGGACCTTTCAC-3' (SEQ ID NO: 17) were used as primers. The resulting amplification products were cloned into sequencing cloning vectors and then subjected to sequence analysis by a conventional method.

Figure 3:
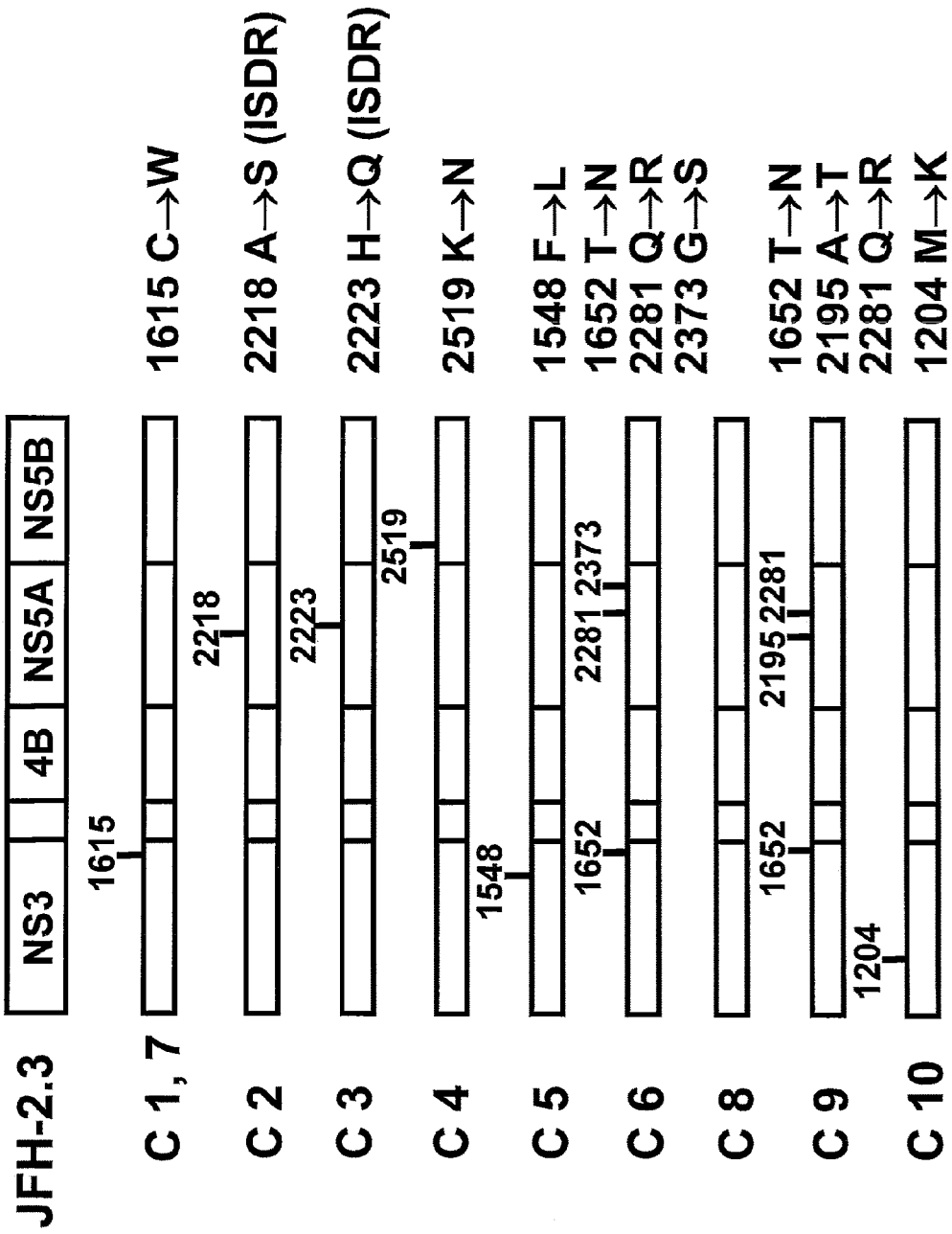

As a result, in the subgenomic replicon RNA obtained from within the cells, nucleotide substitutions causing amino acid substitutions of 4 positions in the NS3 region (M→K at position 1205, F→L at position 1548, C→W at position 1615, and T→N at position 1652), 5 positions in the NS5A region (A→T at position 2196, A→S at position 2218, H→Q at position 2223, Q→R at position 2281, and G→S at position 2373), 1 position in the NS5B region (K→N at position 2519), that are in the nonstructural region, were found (FIG. 3). Most of these amino acid substitutions were present within the NS3 region or the NS5A region, as described above. The positions of these amino acid substitutions are described based on the full-length amino acid sequence (SEQ ID NO: 6) of the precursor protein of the JFH-2.3 strain. Furthermore, the amino acid substitutions at position 2218 of clone 2 and at position 2223 of clone 3 took place within the ISDR region (interferon sensitivity determining region) (FIG. 3). In the amino acid sequence (SEQ ID NO: 6) of the precursor protein of the JFH-2.1/2.3 strain, the ISDR region corresponds to positions 2214 to 2249.

Example 5

Mutation Analysis of HCV Subgenome in JFH-2.3 Subgenomic Replicon Cells

Figure 4:
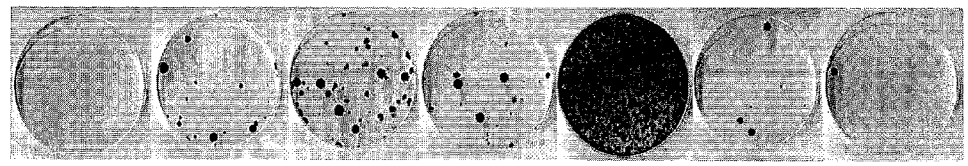

To examine whether or not the nucleotide mutation found in Example 4 affected the replication of the subgenomic replicon RNA in cells, nucleotide substitutions causing amino acid substitutions at 3 positions within the NS3 region (F→L at position 1548, C→W at position 1615, and T→N at position 1652) and at 3 positions within the NS5A region (A→S at position 2218, H→Q at position 2223, and Q→R at position 2281) were each introduced into the HCV JFH-2.1 strain-derived subgenomic replicon RNA expression plasmid vector prepared in Example 1 (FIG. 4A).

Specifically, first, pSGR-JFH-2.1 was used as a template, 10 μl of 10× buffer and 4 μl of 2 mM dNTP mixture attached to the Phusion High-Fidelity DNA Polymerase kit (FINNZYMES), and 1 μl each of 10 μM primers EcoT7-F (5'-CCGGAATTCTAATACGACTC-3' (SEQ ID NO: 18)) and 1548FL-R (5'-GGGCGTGT-TGAGATACGCTCTAAGCCTGAC-3' (SEQ ID NO: 19)) were added, and then deionized water was added to bring the total amount to 49.5 μl in the end. Thereafter, 0.5 μl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 1. Next, pSGR-JFH-2.1 was used as a template, 10 µl of 10× buffer and 4 µl of 2 mM dNTP mixture attached to the Phusion High-Fidelity DNA Polymerase kit (FINNZYMES) and 1 µl each of 10 µM primers 5563-R (5'-CTGCAGCAAGCCTTGGATCT -3' (SEQ ID NO: 20)) and 1548FL-F (5'-TTAGAGCGTATCT-CAACACGCCCGGCCTAC-3' (SEQ ID NO: 21)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. 2.

Those PCR products were each purified and dissolved in 15 µl of H$_2$O. DNAs of PCR product No. 1 and PCR product No. 2 were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers EcoT7-F (5'-CCGGAATTCTAATACGACTC-3' (SEQ ID NO: 18)) and 5563-R (5'-CTGCAGCAAGCCTTGGATCT-3' (SEQ ID NO: 20)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 2 minutes. The resulting PCR product was designated as PCR product No. 3. The PCR product was purified and then dissolved in 30 µl of H$_2$O.

pSGR-JFH-2.1 and the purified PCR product No. 3 were digested with the restriction enzymes EcoR I and EcoT22 I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having a nucleotide substitution causing an amino acid substitution F→L at position 1548 was designated as pSGR-JFH-2.1 F1548L.

pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers EcoT7-F (5'-CCGGAATTCTAATAC-GACTC-3' (SEQ ID NO: 18)) and 1615CW-R (5'-AGTCGGGCCAGCCACTTCCACATGGCGTCC-3' (SEQ ID NO: 22)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 4. Next, pSGR-JFH-2.1 was used as a template, 10 µl of 10× buffer and 4 µl of 2 mM dNTP mixture attached to the Phusion High-Fidelity DNA Polymerase kit (FINNZYMES) and 1 µl each of 10 µM primers 5563-R (5'-CTGCAGCAAGCCTTG-GATCT -3' (SEQ ID NO: 20)) and 1615CW-F (5'-ATGTG-GAAGTGGCTGGCCCGACTCAAGCCT-3' (SEQ ID NO: 23)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. 5.

PCR products were each purified and dissolved in 15 µl of H$_2$O. DNAs of PCR product No. 4 and PCR product No. 5 were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers EcoT7-F (5'-CCGGAATTCTAATACGACTC-3' (SEQ ID NO: 18)) and 5563-R (5'-CTGCAGCAAGCCTTGGATCT-3' (SEQ ID NO: 20)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 2 minutes. The resulting PCR product was designated as PCR product No. 6. The PCR product was purified and then dissolved in 30 µl of H$_2$O.

pSGR-JFH-2.1 and the purified PCR product No. 6 were digested with restriction enzymes EcoR I and EcoT22 I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having a nucleotide substitution causing an amino acid substitution C→W at position 1615 was designated as pSGR-JFH-2.1 C1615W.

pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers EcoT7-F (5'-CCGGAATTCTAATAC-GACTC-3' (SEQ ID NO: 18)) and 1652TN-R (5'-CTTGCAT-GCAATTGGCGATGTACTTCGTCC-3' (SEQ ID NO: 24)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 7. Next, pSGR-JFH-2.1 was used as a template, 10 µl of 10× buffer and 4 µl of 2 mM dNTP mixture attached to the Phusion High-Fidelity DNA Polymerase kit (FINNZYMES) and 1 µl each of 10 µM primers 5563-R (5'-CTGCAGCAAGCCTTGGATCT -3' (SEQ ID NO: 20)) and 1652TN-F (5'-GTACATCGCCAAT-TGCATGCAAGCTGACCT-3' (SEQ ID NO: 25)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. 8.

PCR products were each purified and dissolved in 15 µl of H$_2$O. DNAs of PCR product No. 7 and PCR product No. 8 were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers EcoT7-F (5'-CCGGAATTCTAATACGACTC-3' (SEQ ID NO: 18)) and 5563-R (5'-CTGCAGCAAGCCTTGGATCT-3' (SEQ ID NO: 20)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 2 minutes. The resulting PCR product was designated as PCR product No. 9. The PCR product was purified and then dissolved in 30 µl of H₂O.

pSGR-JFH-2.1 and the purified PCR product No. 9 were digested with restriction enzymes EcoR I and EcoT22 I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having a nucleotide substitution causing an amino acid substitution T→N at position 1652 was designated as pSGR-JFH-2.1 T1652N.

pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 5162-F (5'-TGGGACGCCATGTG-GAAGTG -3' (SEQ ID NO: 26)) and 2196AT-R (5'-TGATC-CCCGTGTCAAGCGCCGCGCCGCAGT-3' (SEQ ID NO: 27)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 10. Next, pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 7827-R (5'-AAAGTTACCTTTT-TAGCCCT -3' (SEQ ID NO: 28)) and 2196AT-F (5'-CGCG-GCGCTTGACACGGGGATCACCTCCAT-3' (SEQ ID NO: 29)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. 11.

PCR products were each purified and dissolved in 15 µl of H₂O. DNAs of PCR product No. 10 and PCR product No. 11 were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers 5162-F (5'-TGGGACGCCATGTGGAAGTG-3' (SEQ ID NO: 26)) and 7827-R (5'-AAAGTTACCTTTTTAGCCCT-3' (SEQ ID NO: 28)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 2 minutes. The resulting PCR product was designated as PCR product No. 12. The PCR product was purified and then dissolved in 30 µl of H₂O.

pSGR-JFH-2.1 and the purified PCR product No. 12 were digested with restriction enzymes EcoT22 I and Psi I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having a nucleotide substitution causing an amino acid substitution A→T at position 2196 was designated as pSGR-JFH-2.1 A2196T.

pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 5162-F (5'-TGGGACGCCATGTG-GAAGTG-3' (SEQ ID NO: 26)) and 2218AS-R (5'-GGTG-CAGGTGGACCGCAGCGACGGTGCTGA-3' (SEQ ID NO: 30)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 13. Next, pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 7827-R (5'-AAAGTTACCTTTT-TAGCCCT-3' (SEQ ID NO: 28)) and 2218AS-F (5'-CCGTCGCTGCGGTCCACCTGCACCACCCAC-3' (SEQ ID NO: 31)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. 14.

PCR products were each purified and dissolved in 15 µl of H₂O. DNAs of PCR product No. 13 and PCR product No. 14 were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers 5162-F (5'-TGGGACGCCATGTGGAAGTG-3' (SEQ ID NO: 26)) and 7827-R (5'-AAAGTTACCTTTTTAGCCCT-3' (SEQ ID NO: 28)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 2 minutes. The resulting PCR product was designated as PCR product No. 15. The PCR product was purified and then dissolved in 30 µl of H₂O.

pSGR-JFH-2.1 and the purified PCR product No. 15 were digested with restriction enzymes EcoT22 I and Psi I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having a nucleotide substitution causing an amino acid substitution A→S at position 2218 was designated as pSGR-JFH-2.1 A2218S.

pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 5162-F (5'-TGGGACGCCATGTG-GAAGTG-3' (SEQ ID NO: 26)) and 2223HQ-R (5'-TAGGT-GTTGCTTTGGGTGGTGCAGGTGGCC-3' (SEQ ID NO: 32)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 16. Next, pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 7827-R (5'-AAAGTTACCTTTT-TAGCCCT -3' (SEQ ID NO: 28)) and 2223HQ-F (5'-CTG-CACCACCCAAAGCAACACCTATGACGT-3' (SEQ ID NO: 33)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. 17.

PCR products were each purified and dissolved in 15 µl of H$_2$O. DNAs of PCR product No. 16 and PCR product No. 17 were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers 5162-F (5'-TGGGACGCCATGTGGAAGTG-3' (SEQ ID NO: 26)) and 7827-R (5'-AAAGTTACCTTTTTAGCCCT-3' (SEQ ID NO: 28)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 2 minutes. The resulting PCR product was designated as PCR product No. 18. The PCR product was purified and then dissolved in 30 µl of H$_2$O.

pSGR-JFH-2.1 and the purified PCR product No. 18 were digested with restriction enzymes EcoT22 I and Psi I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having a nucleotide substitution causing amino acid substitution H→K at position 2223 was designated as pSGR-JFH-2.1 H2223Q.

pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 5162-F (5'-TGGGACGCCATGTG-GAAGTG-3' (SEQ ID NO: 26)) and 2281QR-R (5'-TGG-GAATTGTTTCTCGGGG-3' (SEQ ID NO: 35)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. X. Next, pSGR-JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 7827-R (5'-AAAGTTACCTTTTTAGCCCT-3' (SEQ ID NO: 28)) and 2281QR-F (5'-TACTTGATC-CCCGAGAAAC-3' (SEQ ID NO: 34)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. Y.

PCR products were each purified and dissolved in 15 µl of H$_2$O. DNAs of PCR product No. X and PCR product No. Y were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers 5162-F (5'-TGGGACGCCATGTGGAAGTG-3' (SEQ ID NO: 26)) and 7827-R (5'-AAAGTTACCTTTTTAGCCCT-3' (SEQ ID NO: 28)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 2 minutes. The resulting PCR product was designated as PCR product No. Z. The PCR product was purified and then dissolved in 30 µl of H$_2$O.

pSGR-JFH-2.1 and the purified PCR product No. Z were digested with restriction enzymes EcoT22 I and Psi I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having a nucleotide substitution causing amino acid substitution Q→R at position 2281 was designated as pSGR-JFH-2.1 Q2281R.

These plasmids were cleaved with Xba I and then subjected to phenol chloroform extraction and ethanol precipitation. Each HCV RNA was synthesized using the thus cleaved plasmids as templates and a MEGAscript T7 kit (Ambion).

The mutant JFH-2.1-derived subgenomic replicon RNA (3 µg) obtained as described above was introduced into Huh7 cells by electroporation. The electroporated Huh7 cells were seeded on a culture dish and cultured for 16 to 24 hours, and then G418 (neomycin) was added to the culture dish. Then, the culture was continued while replacing the culture medium twice a week. After 21 days of culture following seeding, viable cells were stained with crystal violet (FIG. 4B). As a result, whereas no colony formation could be observed in cells into which the JFH-2.1-derived subgenomic replicon RNA without mutation (FIG. 4B, top) had been introduced, colony formation was clearly observed in cells into which the mutation-introduced subgenomic replicon RNA had been introduced. In particular, the subgenomic replicon RNA with A→S mutation at position 2218 exerted significantly increased colony forming capacity, indicating the acquisition of high replicon replication capacity. Therefore, it was demonstrated that these amino acid mutations found as described above in the HCV precursor proteins, in particular A→S amino acid mutation at position 2218 (hereinafter also referred to as A(2218)S), enhance replication of HCV subgenomic replicon RNA.

Example 6

Construction of Expression Vectors pJ6/JFH-2.1 and pJ6/JFH-2.1 A2218S

In order to evaluate whether or not HCV particles could be produced in cultured cells by using a replicon RNA based on the JFH-2.1 strain-derived mutant HCV genome sequence as obtained in the above Examples, plasmid vectors expressing the replicon RNA having the full-length HCV genome sequence (HCV full-genomic replicon RNA) were constructed.

Specifically, with reference to the report that a J6/JFH-1 chimeric HCV genome is capable of efficiently producing HCV particles (Lindenbach et al., Science (2005) 309, p 623-626), using another HCV strain, a JFH-1 strain (genotype 2a)-derived 5' UTR sequence (SEQ ID NO: 8), the sequence of a J6CF strain (genotype 2a)-derived structural region (containing sequences of Core, E1, E2, and p7 regions; SEQ ID NO: 7), a JFH-1 strain-derived NS2 region (SEQ ID NO: 9), and a JFH-2.1 strain-derived sequence ranging from the NS3 region to 3' UTR (containing NS3, NS4A, NS4B, NS5A, and NS5B regions and 3' UTR; SEQ ID NO: 10) were ligated in this order to form the chimeric HCV genome sequence J6/JFH-2.1 (SEQ ID NO: 11) (FIG. 5B). Then the chimeric HCV genome sequence J6/JFH-2.1 was incorporated under control of a T7 promoter in plasmid pUC19, thereby constructing a recombinant expression vector pJ6/JFH-2.1, as described below. A vector pJ6/JFH-2.1 A2217S expressing the mutant replicon J6/JFH-2.1 A2217S (FIG. 5B) prepared by introducing A(2218)S mutation within the NS5A region demonstrated in Example 5 to increase the efficiency of replicon replication into J6/JFH-2.1. The nucleotide sequence of J6/JFH-2.1 A2217S is shown in SEQ ID NO: 12. In the sequence of SEQ ID NO: 12, G at nucleotide position 6989 of J6/JFH-2.1 (SEQ ID NO: 11) was changed to T, so that amino acid mutation from A to S at position 2217 was introduced. Construction was carried out by procedures according to the previous report (Wakita, T et al., Nat. Med., 11: 791-796, 2005). The amino acid sequence of the precursor protein encoded by the full-length genome sequence of J6/JFH-2.1 A2217S is shown in SEQ ID NO: 88. The amino acid at position 2218 in the JFH-2.1 full-length amino acid sequence shown in SEQ ID NO: 5 is alanine (A), and the alanine located at this position is aligned with the alanine at position 2217 in the full-length amino acid sequence of chimeric HCV, J6/JFH2.1. That is, in the protein encoded by the full-length genome nucleotide sequence of J6/JFH-2.1 A2217S (SEQ ID NO: 12), alanine at position 2217 is substituted with serine (S). In this case, this substitution also corresponds to amino acid substitution A(2218)S as defined using the amino acid sequence shown in SEQ ID NO: 6 as a reference sequence. The name of the mutant replicon has been changed from the previous name, J6/JFH-2.1 A2218S to J6/JFH-2.1 A2117S just for reasons of expediency, and thus they refer to the same replicon. The name of the expression vector encoding the mutant replicon was also changed to pJ6/JFH-2.1 A2117S similarly.

Specifically, pJ6/JFH-2.1 was used as a template, 10 μl of 10× buffer and 4 μl of 2 mM dNTP mixture attached to the Phusion High-Fidelity DNA Polymerase kit (FINNZYMES), and 1 μl each of 10 μM primers 5162-F (5'-TGGGACGC-CATGTGGAAGTG-3' (SEQ ID NO: 26)) and 2218AS-R (5'-GGTGCAGGTGGACCGCAGCGACGGTGCTGA-3' (SEQ ID NO: 30)) were added, and then deionized water was added to bring the total amount to 49.5 μl in the end. Thereafter, 0.5 μl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 19. Next, pJ6/JFH-2.1 was used as a template, 10 μl of 10× buffer and 4 μl of 2 mM dNTP mixture attached to the Phusion High-Fidelity DNA Polymerase kit (FINNZYMES), and 1 μl each of 10 μM primers 7827-R (5'-AAAGTTACCTTTT-TAGCCCT-3' (SEQ ID NO: 28)) and 2218AS-F (5'-CCGTCGCTGCGGTCCACCTGCACCACCCAC-3' (SEQ ID NO: 31)) were added, and then deionized water was added to bring the total amount to 49.5 μl in the end. Thereafter, 0.5 μl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. 20.

These PCR products were each purified and dissolved in 15 μl of H₂O. DNAs of PCR product No. 19 and PCR product No. 20 were mixed in amounts of 1 μl each. The resultant was used as a template, 10 μl of 10× buffer and 4 μl of the 2 mM dNTP mixture attached to the Phusion High-Fidelity DNA Polymerase kit (FINNZYMES), and 1 μl each of 10 μM primers 5162-F (5'-TGGGACGCCATGTGGAAGTG-3' (SEQ ID NO: 26)) and 7827-R (5'-AAAGTTACCTTTT-TAGCCCT-3' (SEQ ID NO: 28)) were added, and deionized water was added to bring the total amount to 49.5 μl in the end. Thereafter, 0.5 μl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 2 minutes. The resulting PCR product was designated as PCR product No. 21. The PCR product was purified and then dissolved in 30 μl of H₂O.

pJ6/JFH-2.1 and the purified PCR product No. 21 were digested with restriction enzymes EcoT22 I and Psi I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having a nucleotide substitution causing amino acid substitution A→S at position 2218 was designated as pJ6/JFH-2.1 A2217S.

Example 7

Figure 6:
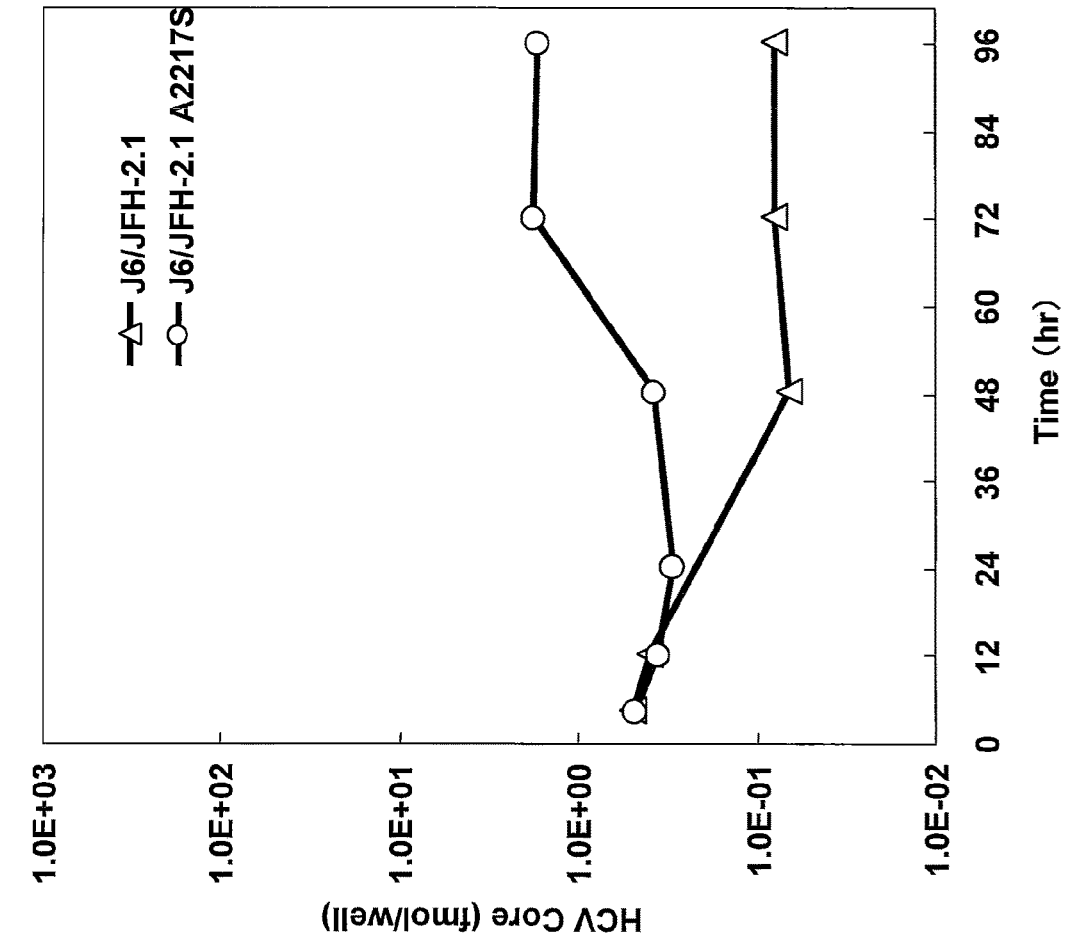

Evaluation of HCV Replicon Replication Capacity in Cells into which J6/JFH-2.1 and J6/JFH-2.1 A2217S RNA has been Introduced HCV replicon RNA (chimeric HCV full-genomic replicon RNA) was prepared by procedures similar to those in Example 2 using the expression vectors pJ6/JFH-2.1 and pJ6/JFH-2.1 A2217S constructed in Example 6. The thus obtained HCV replicon RNAs, J6/JFH-2.1 HCV RNA and J6/JFH-2.1 A2217S HCV RNA were each introduced into Huh7 cells by electroporation. After introduction, cells were collected at 4, 12, 24, 48, 72, and 96 hours after electroporation and then HCV Core protein contained in the cells was quantified using an HCV antigen ELISA test kit (Ortho Clinical Diagnostics), and thereby HCV replicon replication capacity in cells was evaluated (FIG. 6).

As a result, the amount of Core protein in cells into which J6/JFH-2.1 A2217S HCV RNA had been introduced was found to increase at 48 hours after introduction and thereafter, indicating efficient replication of the HCV replicon in the cells. In contrast, the amount of Core protein in cells into which J6/JFH-2.1 HCV RNA had been introduced was not found to have increased even at 96 hours after introduction. The above results demonstrated that A→S mutation at position 2218 in the NS5A region was also important for efficient replication of the chimeric HCV replicon RNA in cells. Herein, "position 2218" means a mutation position as defined using the amino acid sequence shown in SEQ ID NO: 6 as a reference sequence, and the corresponding mutation in the full-length amino acid sequence of the mutated chimeric HCV is A→S mutation at position 2217.

Example 8

Figure 7:
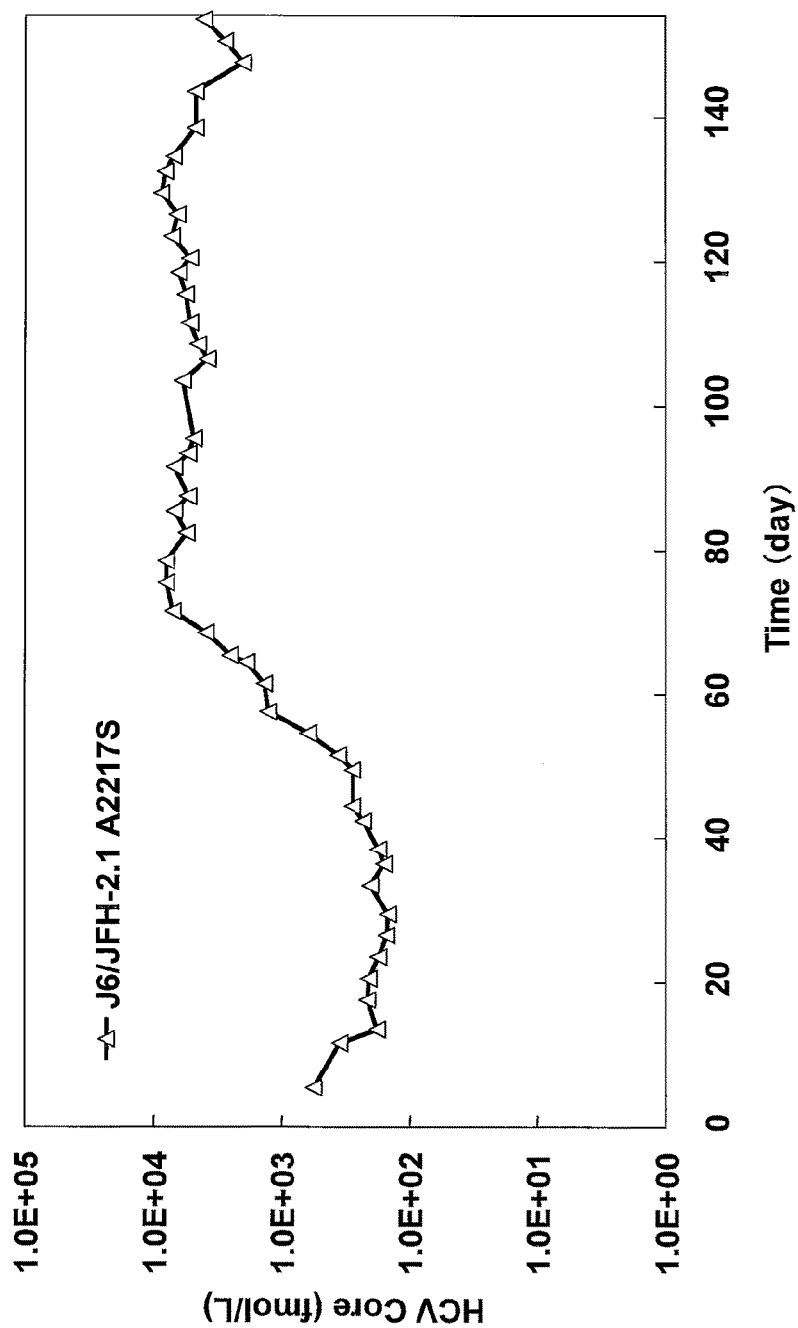

Evaluation of HCV Particle-Producing Capacity in Cells into which J6/JFH-2.1 A2217S HCV RNA has been Introduced While subculturing Huh7 cells into which J6/JFH-2.1 A2217S HCV RNA had been introduced in a manner similar to that in Example 7 in a culture medium (Dulbecco's modified Eagle medium (DMEM)-10% fetal bovine serum), HCV Core protein contained in a culture supernatant was quantified over time using an HCV antigen ELISA test kit (Ortho Clinical Diagnostics) to confirm the production of HCV particles (FIG. 7).

As a result, whereas almost no Core protein was confirmed in the culture supernatant for 60 days after HCV replicon RNA introduction, the amount of Core protein was found to increase at 60 days to 80 days after introduction. After 80 days, Core protein was detected at an almost constant level. These results demonstrated that J6/JFH-2.1 A2217S HCV RNA enabled production of viral particles capable of being released extracellularly, when cells were subcultured after introduction of the RNA thereinto.

Example 9

Evaluation of Infectivity of J6/JFH-2.1 A2217S HCV Particles

Whether or not the J6/JFH-2.1 A2217S HCV RNA-derived HCV particles (hereinafter, J6/JFH-2.1 A2217S HCV particles), the production of which was confirmed in Example 8, had infectivity was examined. First, J6/JFH-2.1 A2217S HCV RNA was introduced into Huh7 cells by electroporation, similarly to the above Example, and then subculture was carried out. The culture supernatant on day 88 after introduction into cells was added to naive Huh7 cells. After 72 hours, the number of HCV-infected cells was determined by a focus-forming assay, and the infectious titer was calculated (FIG. 8).

As a result, the infectious titer was found to be $5.21 \times 10^3$ ffu/ml. The value was divided by the amount of HCV Core ($3.96 \times 10^3$ fmol/L) in the culture supernatant. Thus, the infectious titer per unit HCV protein was calculated to be 1.32 (infectious titer/Core value).

The result demonstrated that HCV particles produced via introduction of J6/JFH-2.1 A2217S HCV RNA into cells had infectivity.

Example 10

Figure 9:
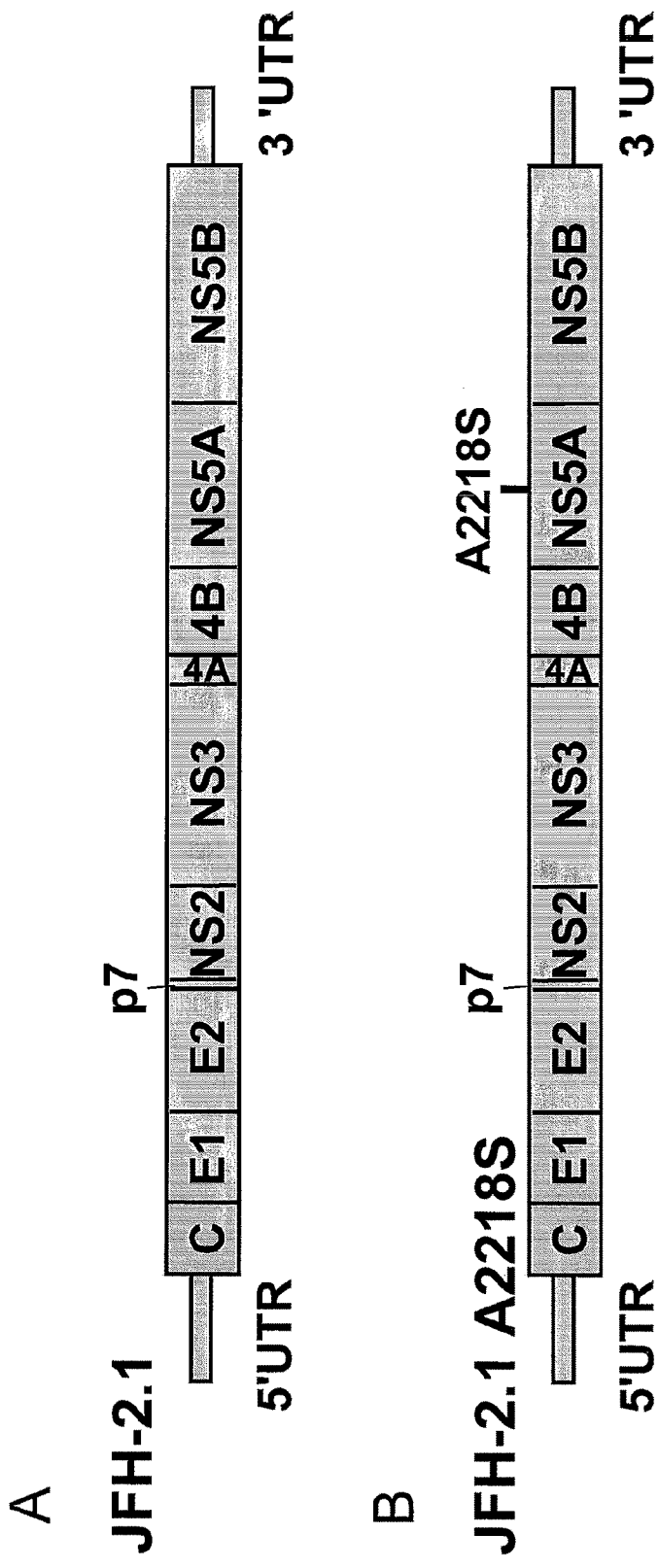

Construction of JFH-2.1 and JFH-2.1 A2218S HCV Full-Genomic Replicon RNA Expression Vectors A plasmid vector pJFH-2.1 expressing replicon RNA having the full-length genome sequence (HCV full-genomic replicon RNA (FIG. 9A)) of the JFH-2.1 strain that comprises the 5' UTR region, structural region (Core, E1, E2, and p7 regions), nonstructural region (NS2, NS3, NS4A, NS4B, NS5A, and NS5B regions), and the 3' UTR region, was constructed in order to evaluate whether or not HCV particles could be produced in cultured cells using the HCV genome RNA of the JFH-2.1 strain based on the results of Examples 6-9 demonstrating that a chimeric HCV full-genomic replicon, J6/JFH-2.1 A2217S HCV RNA, made it possible to produce infectious HCV particles.

Also, A→S mutation at position 2218 in the NS5A region demonstrated in Examples 7-9 to be important for intracellular replication of J6/JFH-2.1 A2217S chimeric HCV replicon RNA or production of infectious HCV particles therefrom was introduced into the JFH-2.1 genome sequence in a manner similar to that in Example 6. A vector pJFH-2.1 A2218S expressing the mutant full genomic replicon JFH-2.1 A2218S (FIG. 9B) was constructed. The construction was carried out by procedures according to the previous report (Wakita, T et al., Nat Med., (2005)). The nucleotide sequence of JFH-2.1 A2218S is shown in SEQ ID NO: 13. In the sequence of SEQ ID NO: 13, A2218S amino acid mutation had been introduced by alternation of G to T at nucleotide position 6992 of JFH-2.1 (SEQ ID NO: 3).

Example 11

Figure 10:
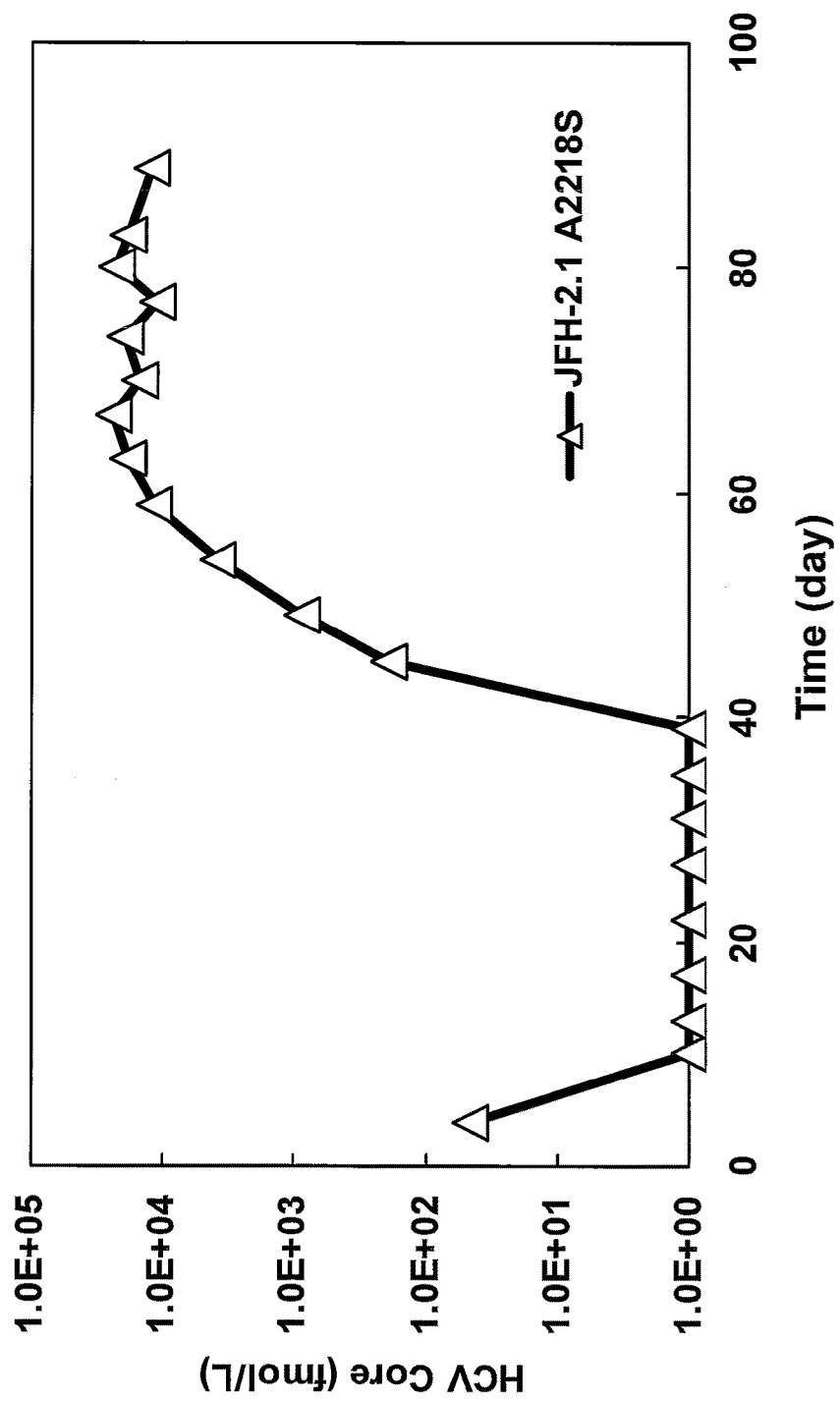

Evaluation of HCV Particle-Producing Capacity in Cells into which JFH-2.1 A2218S HCV RNA has been Introduced HCV replicon RNA (mutant HCV full-genomic replicon RNA) was prepared by techniques similar to those in Example 2 using the expression vector pJFH-2.1 A2218S constructed in Example 10. The thus obtained HCV replicon RNA, JFH-2.1 A2218S HCV RNA, was introduced into Huh7 cells by electroporation. Thereafter, while subculturing cells in a culture medium (10% fetal calf serum-containing Dulbecco's modified Eagle's medium (DMEM)), HCV Core protein contained in the culture supernatant was quantified over time using an HCV antigen ELISA test kit (Ortho Clinical Diagnostics) to confirm the production of HCV particles (FIG. 10).

As a result, almost no Core protein was confirmed in the culture supernatant for 40 days after introduction of HCV replicon RNA. However, the amount of Core protein was found to increase after 40 to 60 days after introduction. On and after 60 days, Core protein was detected at an almost constant level. These results demonstrated that JFH-2.1 A2218S HCV RNA enabled production of viral particles capable of being released extracellularly, when cells were subcultured after introduction of the RNA into the cells.

Example 12

Evaluation of Infectivity of JFH-2.1 A2218S HCV Particles

Whether or not the JFH-2.1 A2218S HCV RNA-derived HCV particles (hereinafter, JFH-2.1 A2218S HCV particles), the production of which was confirmed in Example 11, had infectivity was examined. First, similarly to the above Example, JFH-2.1 A2218S HCV RNA was introduced into Huh7 cells by electroporation, and then subculture was carried out. The culture supernatant on day 63 after introduction into cells was added to naive Huh7 cells. After 72 hours, the number of HCV-infected cells was determined by a focus-forming method, and the infectious titer was calculated (FIG. 11).

As a result, the infectious titer was $4.32 \times 10^4$ ffu/ml. The value was divided by the amount of HCV Core ($1.17 \times 10^4$ fmol/L) in the culture supernatant. Thus, the infectious titer per unit HCV protein was calculated to be 3.69 (infectious titer/Core value). The result demonstrated that HCV particles produced by introduction of JFH-2.1 A2218S HCV RNA into cells had infectivity and the infectious titer per unit protein was found to be higher than that of J6/JFH-2.1 A2217S HCV particles.

Example 13

Mutation Analysis for Nucleotide Sequence Resulting from Subculture of J6/JFH-2.1 A2217S RNA-Replicating Cells Fresh uninfected Huh-7 cells were infected with the culture supernatant of Huh-7 cells (Huh-7 cells into which J6/JFH-2.1 A2217S HCV RNA had been introduced) that contains J6/JFH-2.1 A2217S HCV particles with high infectious titer obtained in Example 8, at moi (multiplicity of infection) of 0.03. The infected cells were subcultured until the amount of Core protein and the infectious titer in the culture supernatant reached 1,000 fmol/L and 1,000 ffu/ml or more, respectively. Infection with the culture supernatant containing the virus and subculture of infected cells were repeated 3 to 4 times and then sequence analysis was conducted for HCV RNA contained in the culture supernatant. Two infection lines were employed and designated as 4A and 4B, respectively. First, RNA was extracted from each culture supernatant of Huh-7 cells containing J6/JFH-2.1 A2217S HCV particles of the infection lines 4A and 4B and then HCV RNA contained therein was amplified by RT-PCR. Random primers (6 mer, Takara Bio Inc.) were used for the amplification. Amplification products were cloned into sequencing cloning vectors and then subjected to sequence analysis by a conventional method.

As a result, in the case of infection line 4A, nucleotide substitutions causing amino acid substitutions at 7 positions: 2 positions (M→K at position 405 and N→T at position 417) in the E2 region that is in the structural region; and 1 position (M→T at position 868) in the NS2 region, 1 position (T→A at position 1642) in the NS3 region, 1 position (I→V at position 1722) in the NS4B region, 1 position (S→G at position 2204) in the NS5A region, and 1 position (T→I at position 2695) in the NS5B region that are in the nonstructural region were found. Also, in the case of infection line 4B, nucleotide substitutions causing amino acid substitutions at 8 positions: 1 position (A→T at position 148) in Core region, 1 position (M→V at position 356) in the E1 region, and 1 position (V→G at position 626) in the E2 region that are in the structural region; and 1 position (I→V at position 1687) in the NS4A region, 1 position (K→R at position 1767) in the NS4B region, 1 position (C→S at position 2219) in the NS5A region, and 2 positions (T→I at position 2695 and L→P at position 3016) in the NS5B region that are in the nonstructural region were found. In addition, the positions of amino acid mutations shown in this Example and the following Examples indicate the positions in the relevant mutant amino acid sequence.

Example 14

Construction of J6/JFH-2.1 A2217S-Derived Mutant HCV Full Genome RNA Expression Vector Plasmids were prepared by introducing various combinations of the mutations obtained in Example 13 into the plasmid pJ6/JFH-2.1 A2217S in order to confirm whether or not the mutations found in Example 13 were adaptive mutations. Specifically, pJ6/JFH-2.1 A2217S was used as a template, 10 μl of 10× buffer and 4 μl of 2 mM dNTP mixture attached to the Phusion High-Fidelity DNA Polymerase kit (FINNZYMES), and 1 μl each of 10 μM primers 2219CS-S (5'-GCGTTCCACCAGTGCCACCCACGGCACGGC-3' (SEQ ID NO: 36)) and 8035R-2a (5'-CCACACGGACT-TGATGTGGT-3' (SEQ ID NO: 37)) were added, and then deionized water was added to bring the total amount to 49.5 μl in the end. Thereafter, 0.5 μl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 22. Next, pJ6/JFH-2.1 was used as a template, 10 μl of 10× buffer and 4 μl of 2 mM dNTP mixture attached to the Phusion High-Fidelity DNA Polymerase kit (FINNZYMES), and 1 μl each of 10 μM primers 6586S-IH (5'-CAAGACCGCCATCTGGAGGGTGGCGGCCTC-3' (SEQ ID NO: 38)) and 2219CS-R (5'-GGTGGCACTGGTG-GAACGCAGCGACGGGGC-3' (SEQ ID NO: 39)) were added, and then deionized water was added to bring the total amount to 49.5 μl in the end. Thereafter, 0.5 μl of Phusion DNA Polymerase (FINNZYMES) was added thereto, and PCR was carried out. PCR was carried out for 25 cycles, with each cycle consisting of 98° C. for 10 seconds, 55° C. for 15 seconds, and 72° C. for 1 minute and 30 seconds. The resulting PCR product was designated as PCR product No. 23.

PCR products were each purified and dissolved in 15 μl of H₂O. DNAs of PCR product No. 22 and PCR product No. 23 were mixed in amounts of 1 μl each. The resultant was used as a template, 10 μl of 10× buffer and 4 μl of the 2 mM dNTP mixture attached to the Phusion High-Fidelity DNA Polymerase kit (FINNZYMES), and 1 μl each of 10 μM primers 6586S-IH (5'-CAAGACCGCCATCTGGAGGGTGGCG-GCCTC-3' (SEQ ID NO: 38)) and 8035R-2a (5'-CCACACG-GACTTGATGTGGT-3' (SEQ ID NO: 37)) were added, and deionized water was added to bring the total amount to 49.5 μl in the end. Thereafter, 0.5 μl of Phusion DNA Polymerase (FINNZYMES) was added thereto, and PCR was carried out. PCR was carried out for 25 cycles, with each cycle consisting of 98° C. for 10 seconds, 55° C. for 15 seconds, and 72° C. for 2 minutes. The resulting PCR product was designated as PCR product No. 24. The PCR product was purified and then dissolved in 30 μl of H₂O.

pJ6/JFH-2.1 A2217S and the purified PCR product No. 24 were digested with restriction enzymes Blp I and Psi I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence) and C→S at position 2219 was designated as pJ6/JFH-2.1 A2217S(CS). The nucleotide sequence of mutant HCV full-genomic sequence J6/JFH-2.1 A2217S (CS) cloned into pJ6/JFH-2.1 A2217S(CS) is shown in SEQ ID NO: 78 and the amino acid sequence of an HCV virus precursor protein encoded by the nucleotide sequence is shown in SEQ ID NO: 89.

Next, pJ6/JFH-2.1 A2217S was used as a template, 10 μl of 10× buffer and 4 μl of 2 mM dNTP mixture attached to the Phusion High-Fidelity DNA Polymerase kit (FINNZYMES), and 1 μl each of 10 μM primers 9124S-IH (5'-TTCAGCCCT-CAGAAAACTTGGGGCGCCACC-3' (SEQ ID NO: 40)) and 3016LR-R (5'-GGAGTAGGCTAgGGAGTAA-CAAGCGGGGTC-3' (SEQ ID NO: 41)) were added, and then deionized water was added to bring the total amount to 49.5 μl in the end. Thereafter, 0.5 μl of Phusion DNA Polymerase (FINNZYMES) was added thereto, and PCR was carried out. PCR was carried out for 25 cycles, with each cycle consisting of 98° C. for 10 seconds, 55° C. for 15 seconds, and 72° C. for 30 seconds. The resulting PCR product was designated as PCR product No. 25. Next, pJ6/JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 3016LP-S (5'-TTGTTACTCCCTAGCCTACTC-CTACTCTTT-3' (SEQ ID NO: 42)) and M13R (5'-AA-CAGCTATGACCATG-3' (SEQ ID NO: 43)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 25 cycles, with each cycle consisting of 98° C. for 10 seconds, 55° C. for 15 seconds, and 72° C. for 1 minute and 30 seconds. The resulting PCR product was designated as PCR product No. 26.

PCR products were each purified and dissolved in 15 µl of H$_2$O. DNAs of PCR product No. 25 and PCR product No. 26 were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers 9124S-IH (5'-TTCAGCCCTCAGAAAACTTGGGGCGC-CACC-3' (SEQ ID NO: 40)) and M13R (5'-AACAGCTAT-GACCATG-3' (SEQ ID NO: 43)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 25 cycles, with each cycle consisting of 98° C. for 10 seconds, 55° C. for 15 seconds, and 72° C. for 2 minutes. The resulting PCR product was designated as PCR product No. 27. The PCR product was purified and then dissolved in 30 µl of H$_2$O.

pJ6/JFH-2.1 A2217S and the purified PCR product No. 27 were digested with restriction enzymes EcoR V and Xba I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence) and L→P at position 3016 was designated as pJ6/JFH-2.1 A2217S (LP). The nucleotide sequence of mutant HCV full-genomic sequence J6/JFH-2.1 A2217S (LP) cloned into pJ6/JFH-2.1 A2217S (LP) is shown in SEQ ID NO: 79 and the amino acid sequence of an HCV virus precursor protein encoded by the nucleotide sequence is shown in SEQ ID NO: 90.

Next, cDNA prepared by reverse transcription from the HCV RNA of the infection line 4B obtained in Example 13 was used as a template, 10 µl of 10× buffer and 4 µl of 2 mM dNTP mixture attached to the Phusion High-Fidelity DNA Polymerase kit (FINNZYMES), and 1 µl each of 10 µM primers 7993S-IH (5'-CAGCTTGTCCGGGAGGGC-3' (SEQ ID NO: 44)) and 8892R-2a (5'-AGCCATGAATTGAT-AGGGGA-3' (SEQ ID NO: 45)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 30 seconds. The resulting PCR product was designated as PCR product No. 28.

pJ6/JFH-2.1 A2217S and the purified PCR product No. 28 were digested with restriction enzymes Bsu36 I and Srf I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 was used as a reference sequence) and T→I at position 2695 was designated as pJ6/JFH-2.1 A2217S (TI). The nucleotide sequence of mutant HCV full-genomic sequence J6/JFH-2.1 A2217S (TI) cloned into pJ6/JFH-2.1 A2217S (TI) is shown in SEQ ID NO: 80 and the amino acid sequence of an HCV virus precursor protein encoded by the nucleotide sequence is shown in SEQ ID NO: 91.

Next, pJ6/JFH-2.1 A2217S was used as a template, 10 µl of 10× buffer and 4 µl of 2 mM dNTP mixture attached to the Phusion High-Fidelity DNA Polymerase kit (FINNZYMES), and 1 µl each of 10 µM primers 450S-IH (5'-TGCCGCG-CAGGGGCCCCAGGTTGGGTGTGC-3' (SEQ ID NO: 46)) and 148AT-S (5'-GAGAGCTCTGGtGACGCCGC-CGAGCGGGGC-3' (SEQ ID NO: 47)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 25 cycles, with each cycle consisting of 98° C. for 10 seconds, 55° C. for 15 seconds, and 72° C. for 30 seconds. The resulting PCR product was designated as PCR product No. 29. Next, pJ6/JFH-2.1 was used as a template, 10 µl of 10× buffer and 4 µl of 2 mM dNTP mixture attached to the Phusion High-Fidelity DNA Polymerase kit (FINNZYMES), and 1 µl each of 10 µM primers 148AT-R (5'-GGCGGCGTCaCCAGAGCTCTCGCGCATGGC-3' (SEQ ID NO: 48)) and 1440R-IH (5'-GCTCCCTGCATA-GAGAAGTA-3' (SEQ ID NO: 49)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 1 minute and 30 seconds. The resulting PCR product was designated as PCR product No. 30.

PCR products were each purified and dissolved in 15 µl of H$_2$O. DNAs of PCR product No. 29 and PCR product No. 30 were mixed in amounts of 1 µl each. The resultant was used as a template, 10 µl of 10× buffer and 4 µl of the 2 mM dNTP mixture attached to the Phusion High-Fidelity DNA Polymerase kit (FINNZYMES), and 1 µl each of 10 µM primers 450S-IH (5'-TGCCGCGCAGGGGCCCCAGGTTGGGT-GTGC-3' (SEQ ID NO: 46)) and 1440R-IH (5'-GCTCCCT-GCATAGAGAAGTA-3' (SEQ ID NO: 49)) were added, and deionized water was added to bring the total amount to 49.5 µl in the end. Thereafter, 0.5 µl of Phusion DNA Polymerase (FINNZYMES) was added thereto, and PCR was carried out. PCR was carried out for 25 cycles, with each cycle consisting of 98° C. for 10 seconds, 55° C. for 15 seconds, and 72° C. for 2 minutes. The resulting PCR product was designated as PCR product No. 31. The PCR product was purified and then dissolved in 30 µl of H$_2$O.

pJ6/JFH-2.1 A2217S and the purified PCR product No. 31 were digested with restriction enzymes Cla I and Bsiw I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence) and A→T at position 148 was designated as pJ6/JFH-2.1 A2217S) (AT).

Similarly, recombinant expression vectors, pJ6/JFH-2.1 A2217S(CS/LP), pJ6/JFH-2.1 A2217S(CS/TI), pJ6/JFH-2.1 A2217S (TI/LP), pJ6/JFH-2.1 A2217S (CS/TI/LP), and pJ6/JFH-2.1 A2217S (AT/CS/TI/LP) were constructed. In addition, these vectors were constructed by introducing the above-indicated amino acid mutations in various combinations into the full-length amino acid sequence of J6/JFH-2.1 A2217S. The nucleotide sequences of the mutant HCV full-genomic sequences, J6/JFH-2.1 A2217S(CS/LP), J6/JFH-2.1 A2217S(CS/TI), J6/JFH-2.1 A2217S (TI/LP), J6/JFH-2.1 A2217S(CS/TI/LP), and J6/JFH-2.1 A2217S (AT/CS/TI/LP) cloned into the pJ6/JFH-2.1 A2217S(CS/LP), pJ6/JFH-2.1 A2217S (CS/TI), pJ6/JFH-2.1 A2217S (TI/LP), pJ6/JFH-2.1 A2217S (CS/TI/LP), and pJ6/JFH-2.1 A2217S (AT/CS/TI/LP) vectors are shown in SEQ ID NOS: 81, 82, 83, 84, and 85, respectively. The amino acid sequences of HCV virus precursor proteins encoded by the nucleotide sequences are shown in SEQ ID NO: 92, 93, 94, 95, and 96, respectively.

A virus replicon into which all mutations of infection line 4A had been introduced was prepared as follows. First, cDNA prepared by reverse transcription from the HCV RNA of infection line 4A obtained in Example 13 was used as a template, 10 µl of 10× buffer and 4 µl of 2 mM dNTP mixture attached to the Phusion High-Fidelity DNA Polymerase kit (FINNZYMES), and 1 µl each of 10 µM primers 2099S-2a (5'-ACGGACTGTTTTAGGAAGCA-3' (SEQ ID NO: 50)) and 3509R-2a (5'-TCTTGTCGCGCCCCGTCA-3' (SEQ ID NO: 51)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 35 cycles, with each cycle consisting of 98° C. for 10 seconds, 55° C. for 15 seconds, and 72° C. for 20 seconds. The resulting PCR product was used as a template, 10 µl of 10× buffer and 4 µl of 2 mM dNTP mixture attached to the Phusion High-Fidelity DNA Polymerase kit (FINNZYMES), and 1 µl each of 10 µM primers 2285S-2a (5'-AATTTCACTCGTGGGGATCG-3' (SEQ ID NO: 52)) and 3280R-IH (5'-TGACCTTCTTCTCCATCGGACTG-3' (SEQ ID NO: 53)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 20 seconds. The resulting PCR product was designated as PCR product No. 32. pJ6/JFH-2.1 A2217S (TI) and the purified PCR product No. 32 were digested with restriction enzymes Kpn I and Af III. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence), T→I at position 2695, and M→T at position 868 was designated as pJ6/JFH-2.1 A2217S (TI/MT).

Next, cDNA containing nucleotide substitutions causing M→K mutation at position 405 and N→T mutation at position 417 prepared by reverse transcription from the HCV RNA of infection line 4A obtained in Example 13 was used as a template, 10 µl of 10× buffer and 4 µl of 2 mM dNTP mixture attached to the Phusion High-Fidelity DNA Polymerase kit (FINNZYMES), and 1 µl each of 10 µM primers 2099S-2a (5'-ACGGACTGTTTTAGGAAGCA-3' (SEQ ID NO: 50)) and 3509R-2a (5'-TCTTGTCGCGCCCCGTCA-3' (SEQ ID NO: 51)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 20 seconds. The PCR product was used as a template, 10 µl of 10× buffer and 4 µl of 2 mM dNTP mixture attached to the Phusion High-Fidelity DNA Polymerase kit (FINNZYMES), and 1 µl each of 10 µM primers 2285S-2a (5'-AATTTCACTCGTGGG-GATCG-3' (SEQ ID NO: 52)) and 3280R-IH (5'-TGACCT-TCTTCTCCATCGGACTG-3' (SEQ ID NO: 53)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 40 cycles, with each cycle consisting of 98° C. for 10 seconds, 55° C. for 15 seconds, and 72° C. for 20 seconds. The resulting PCR product was designated as PCR product No. 33. pJ6/JFH-2.1 A2217S (TI/MT) and the purified PCR product No. 33 were digested with restriction enzyme Kpn I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence), T→I at position 2695, M→T at position 868, M→K at position 405, and N→T at position 417 was designated as pJ6/JFH-2.1 A2217S (TI/MT/MK/NT).

Next, cDNA containing a nucleotide substitution causing I→V mutation at position 1722 prepared by reverse transcription from the HCV RNA of infection line 4A obtained in Example 13 was used as a template, 10 µl of 10× buffer and 4 µl of 2 mM dNTP mixture attached to the LA-Taq DNA Polymerase kit (Takara Bio Inc.), and 1 µl each of 10 µM primers 4547S-2a (5'-AAGTGTGACGAGCTCGCGG-3' (SEQ ID NO: 54)) and 7677R-IH (5'-TATGACATGGAG-CAGCACAC-3' (SEQ ID NO: 55)) were added, and then deionized water was added to bring the total amount to 49.5 µl in the end. Thereafter, 0.5 µl of LA-Taq DNA Polymerase (Takara Bio Inc.) was added thereto, and PCR was carried out. PCR was carried out for 30 cycles, with each cycle consisting of 95° C. for 30 seconds, 60° C. for 30 seconds, and 72° C. for 3 minutes. The PCR product was used as a template, 10 µl of 10× buffer and 4 µl of 2 mM dNTP mixture attached to the LA-Taq DNA Polymerase kit (Takara Bio Inc.), and 1 µl each of 10 µM primers 4607S-IH (5'-AGAGGGTTG-GACGTCTCCATAATACCA-3' (SEQ ID NO: 56)) and 7214R-NS (5'-CAGGCCGCGCCCAGGCCGGCAAG-GCTGGTG-3' (SEQ ID NO: 57)) were added, and then deionized water was added to bring the total amount to 49.5 µl in the end. Thereafter, 0.5 µl of LA-Taq DNA Polymerase (Takara Bio Inc.) was added thereto, and PCR was carried out. PCR was carried out for 30 cycles, with each cycle consisting of 95° C. for 30 seconds, 60° C. for 30 seconds, and 72° C. for 2 minutes and 30 seconds. The resulting PCR product was designated as PCR product No. 34. pJ6/JFH-2.1 A2217S (TI/MT/MK/NT) and the purified PCR product No. 34 were digested with restriction enzymes Xho I and Blp I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence), T→I at position 2695, M→T at position 868, M→K at position 405, N→T at position 417, and I→V at position 1722 was designated as pJ6/JFH -2.1 A2217S (TI/MT/MK/NT/IV).

Next, cDNA containing a nucleotide substitution causing S→G mutation at position 2204 prepared by reverse transcription from the HCV RNA of infection line 4A obtained in Example 13 was used as a template, 10 μl of 10× buffer and 4 μl of 2 mM dNTP mixture attached to the LA-Taq DNA Polymerase kit (Takara Bio Inc.), and 1 μl each of 10 μM primers 6499S-NS (5'-TAAGACCTGCATGAACACCTG-GCAGGGGAC-3' (SEQ ID NO: 58)) and 3'X-8077R-IH (5'-ACATGATCTGCAGAGAGACCAGTTACGG-3' (SEQ ID NO: 59)) were added, and then deionized water was added to bring the total amount to 49.5 μl in the end. Thereafter, 0.5 μl of LA-Taq DNA Polymerase (Takara Bio Inc.) was added thereto, and PCR was carried out. PCR was carried out for 30 cycles, with each cycle consisting of 95° C. for 30 seconds, 60° C. for 30 seconds, and 72° C. for 3 minutes. The PCR product was used as a template, 10 μl of 10× buffer and 4 μl of 2 mM dNTP mixture attached to the LA-Taq DNA Polymerase kit (Takara Bio Inc.), and 1 μl each of 10 μM primers 6698S-NS (5'-ATACCATCTCCAGAGTTCTTTTC-CTGGGTA-3' (SEQ ID NO: 60)) and 3'X-75R -2a (5'-TACG-GCACCTCTCTGCAGTCA-3' (SEQ ID NO: 61)) were added, and then deionized water was added to bring the total amount to 49.5 μl in the end. Thereafter, 0.5 μl of LA-Taq DNA Polymerase (Takara Bio Inc.) was added thereto, and PCR was carried out. PCR was carried out for 30 cycles, with each cycle consisting of 95° C. for 30 seconds, 60° C. for 30 seconds, and 72° C. for 2 minutes and 30 seconds. The resulting PCR product was designated as PCR product No. 35. pJ6/JFH-2.1 A2217S (TI/MT/MK/NT/IV) and the purified PCR product No. 35 were digested with restriction enzymes Blp I and Psi I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence), T→I at position 2695, M→T at position 868, M→K at position 405, N→T at position 417, I→V at position 1722, and S→G at position 2204 was designated as pJ6/JFH-2. 1 A2217S (TI/MT/MK/NT/IV/SG).

Next, cDNA containing a nucleotide substitution causing T→A mutation at position 1642 prepared by reverse transcription from the HCV RNA of infection line 4A obtained in Example 13 was used as a template, 10 μl of 10× buffer and 4 μl of 2 mM dNTP mixture attached to the LA-Taq DNA Polymerase kit (Takara Bio Inc.), and 1 μl each of 10 μM primers 4547S-2a (5'-AAGTGTGACGAGCTCGCGG-3' (SEQ ID NO: 62)) and 7677R-IH (5'-TATGACATGGAG-CAGCACAC-3' (SEQ ID NO: 63)) were added, and then deionized water was added to bring the total amount to 49.5 μl in the end. Thereafter, 0.5 μl of Phusion DNA Polymerase (FINNZYMES) was added thereto, and PCR was carried out. PCR was carried out for 30 cycles, with each cycle consisting of 95° C. for 30 seconds, 60° C. for 30 seconds, and 72° C. for 3 minutes. The PCR product was used as a template, 10 μl of 10× buffer and 4 μl of 2 mM dNTP mixture attached to the LA-Taq DNA Polymerase kit (Takara Bio Inc.), and 1 μl each of 10 μM primers 4607S-IH (5'-AGAGGGTTG-GACGTCTCCATAATACCA-3' (SEQ ID NO: 64)) and 7214R-NS (5'-CAGGCCGCGCCCAGGCCGGCAAG-GCTGGTG-3' (SEQ ID NO: 65)) were added, and then deionized water was added to bring the total amount to 49.5 μl in the end. Thereafter, 0.5 μl of LA-Taq DNA Polymerase (Takara Bio Inc.) was added thereto, and PCR was carried out. PCR was carried out for 30 cycles, with each cycle consisting of 95° C. for 30 seconds, 60° C. for 30 seconds, and 72° C. for 2 minutes and 30 seconds. The resulting PCR product was designated as PCR product No. 36. pJ6/JFH-2.1 A2217S (TI/MT/MK/NT/IV/SG) and the purified PCR product No. 36 were digested with restriction enzyme Xho I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence), T→I at position 2695, M→T at position 868, M→K at position 405, N→T at position 417, I→V at position 1722, S→G at position 2204, and T→A at position 1642 was designated as pJ6/JFH-2.1 A2217S (TI/MT/MK/NT/IV/SG/TA). The nucleotide sequence of mutant HCV full-genomic sequence J6/JFH-2.1 A2217S (TI/MT/MK/NT/IV/SG/TA) cloned into pJ6/JFH-2.1 A2217S (TI/MT/MK/NT/IV/SG/TA) is shown in SEQ ID NO: 86 and the amino acid sequence of an HCV virus precursor protein encoded by the nucleotide sequence is shown in SEQ ID NO: 97. Thus, all of the amino acid mutations found in infection line 4A were introduced into the mutant precursor protein encoded by J6/JFH-2.1 A2217S (TI/MT/MK/NT/IV/SG/TA).

Virus into which all mutations of 4B had been introduced was prepared as follows. First, cDNA containing mutations M→V at position 356 and V→G at position 626 prepared by reverse transcription from the HCV RNA of infection line 4B obtained in Example 13 was used as a template, 10 μl of 10× buffer and 4 μl of 2 mM dNTP mixture attached to the LA-Taq DNA Polymerase kit (Takara Bio Inc.), and 1 μl each of 10 μM primers 44S-IH (5'-CTGTGAGGAACTACTGTCTT -3' (SEQ ID NO: 66)) and 3189R-IH (5'-CCAGTCCACCTGC-CAAGG-3' (SEQ ID NO: 67)) were added, and then deionized water was added to bring the total amount to 49.5 μl in the end. Thereafter, 0.5 μl of LA-Taq DNA Polymerase (Takara Bio Inc.) was added thereto, and PCR was carried out. PCR was carried out for 30 cycles, with each cycle consisting of 95° C. for 30 seconds, 60° C. for 30 seconds, and 72° C. for 3 minutes. The PCR product was used as a template, 10 μl of 10× buffer and 4 μl of 2 mM dNTP mixture attached to the LA-Taq DNA Polymerase kit (Takara Bio Inc.), and 1 μl each of 10 μM primers 63S-Con.1 (5'-TTCACGCA-GAAAGCGTCTAG-3' (SEQ ID NO: 68)) and 2445R-2a (5'-TCCACGATGTTTTGGTGGAG-3' (SEQ ID NO: 69)) were added, and then deionized water was added to bring the total amount to 49.5 μl in the end. Thereafter, 0.5 μl of LA-Taq DNA Polymerase (Takara Bio Inc.) was added thereto, and PCR was carried out. PCR was carried out for 30 cycles, with each cycle consisting of 95° C. for 30 seconds, 60° C. for 30 seconds, and 72° C. for 2 minutes and 30 seconds. The resulting PCR product was designated as PCR product No. 37. pJ6/JFH-2.1 A2217S (AT/CS/TI/LP) and the purified PCR product No. 37 were digested with restriction enzymes Bsiw I and Sph I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence), A→T at position 148, C→S at position 2219, T→I at position 2695, L→P at position 3016, M→V at position 356, and V→G at position 626) was designated as pJ6/JFH-2.1 A2217S (AT/CS/TI/LP/MV/VG).

Next, cDNA containing nucleotide substitutions causing I→V mutation at position 1687 and K→R mutation at position 1767 prepared by reverse transcription from the HCV RNA of infection line 4B obtained in Example 13 was used as a template, 10 µl of 10× buffer and 4 µl of 2 mM dNTP mixture attached to the Phusion DNA Polymerase kit (FINNZYMES), and 1 µl each of 10 µM primers 4593S-2a (5'-CTGTGGCATACTACAGAGG-3' (SEQ ID NO: 70)) and 5970R-2a (5'-TTCTCGCCAGACATGATCTT-3' (SEQ ID NO: 71)) were added, and then deionized water was added to bring the total amount to 49.5 µl in the end. Thereafter, 0.5 µl of LA-Taq DNA Polymerase (Takara Bio Inc.) was added thereto, and PCR was carried out. PCR was carried out for 35 cycles, with each cycle consisting of 98° C. for 10 seconds, 55° C. for 15 seconds, and 72° C. for 20 seconds. The PCR product was used as a template, 10 µl of 10× buffer and 4 µl of 2 mM dNTP mixture attached to the Phusion High-Fidelity DNA Polymerase kit (FINNZYMES), and 1 µl each of 10 µM primers 4607S-IH (5'-AGAGGGTTGGACGTCTCCATAATACCA-3' (SEQ ID NO: 72)) and 5970R-2a (5'-TTCTCGCCAGACATGATCTT-3' (SEQ ID NO: 73)) were added, and then deionized water was added to bring the total amount to 49.5 µl in the end. Thereafter, 0.5 µl of Phusion DNA Polymerase (FINNZYMES) was added thereto, and PCR was carried out. PCR was carried out for 30 cycles, with each cycle consisting of 98° C. for 10 seconds, 55° C. for 15 seconds, and 72° C. for 20 seconds. The resulting PCR product was inserted into a pGEM-T Easy vector. Then the plasmid was used as a template, 10 µl of 10× buffer and 4 µl of 2 mM dNTP mixture attached to the LA-Taq DNA Polymerase kit (Takara Bio Inc.), and 1 µl each of 10 µM primers 4547S-2a (5'-AAGTGTGACGAGCTCGCGG-3' (SEQ ID NO: 74)) and 7677R-IH (5'-TATGACATGGAGCAGCACAC-3' (SEQ ID NO: 75)) were added, and then deionized water was added to bring the total amount to 49.5 µl in the end. Thereafter, 0.5 µl of LA-Taq DNA Polymerase (Takara Bio Inc.) was added thereto, and PCR was carried out. PCR was carried out for 30 cycles, with each cycle consisting of 98° C. for 30 seconds, 60° C. for 30 seconds, and 72° C. for 3 minutes. The PCR product was used as a template, 10 µl of 10× buffer and 4 µl of 2 mM dNTP mixture attached to the LA-Taq DNA Polymerase kit (Takara Bio Inc.), and 1 µl each of 10 µM primers 4607S-IH (5'-AGAGGGTTGGACGTCTCCATAATACCA-3' (SEQ ID NO: 76)) and 7214R-NS (5'-CAGGCCGCGCCCAGGCCGGCAAGGCTGGTG-3' (SEQ ID NO: 77)) were added, and then deionized water was added to bring the total amount to 49.5 µl in the end. Thereafter, 0.5 µl of LA-Taq DNA Polymerase (Takara Bio Inc.) was added thereto, and PCR was carried out. PCR was carried out for 30 cycles, with each cycle consisting of 95° C. for 30 seconds, 60° C. for 30 seconds, and 72° C. for 2 minutes and 30 seconds. The thus obtained PCR product was designated as PCR product No. 38. pJ6/JFH-2.1 A2217S (AT/CS/TI/LP/MV/VG) and the purified PCR product No. 39 were digested with restriction enzyme Xho I. Each HCV cDNA fragment was fractionated by agarose gel electrophoresis and then purified. These two DNA fragments were mixed with Ligation Mix (Takara Bio Inc.), and the two DNA fragments were ligated to each other. The thus obtained recombinant expression vector having nucleotide substitutions causing amino acid substitutions A→S at position 2217 (corresponding to amino acid substitution A→S at position 2218 as defined using the amino acid sequence of SEQ ID NO: 6 as a reference sequence), A→T at position 148, C→S at position 2219, T→I at position 2695, L→P at position 3016, M→V at position 356, V→G at position 626, T→S at position 329, I→V at position 1687, and K→R at position 1767 was designated as pJ6/JFH-2.1 A2217S (AT/CS/TI/LP/MV/VG/IV/KR). The nucleotide sequence of mutant HCV full-genomic sequence J6/JFH-2.1 A2217S (AT/CS/TI/LP/MV/VG/IV/KR) cloned into pJ6/JFH-2.1 A2217S (AT/CS/TI/LP/MV/VG/IV/KR) is shown in SEQ ID NO: 87 and the amino acid sequence of an HCV virus precursor protein encoded by the nucleotide sequence is shown in SEQ ID NO: 98. Thus, all of the amino acid mutations found in infection line 4B were introduced into the mutant precursor protein encoded by J6/JFH-2.1 A2217S (AT/CS/TI/LP/MV/VG/IV/KR).

Example 15

Mutation Analysis for Nucleotide Sequence Resulting from Subculture of JFH-2.1 A2218S RNA Replicating Cells Fresh uninfected Huh-7 cells were infected with the culture supernatant of Huh-7 cells (Huh-7 cells into which JFH-2.1 A2218S HCV RNA had been introduced) that contains JFH-2.1 A2218S HCV particles with high infectious titer obtained in Example 8, at moi (multiplicity of infection) of 0.03. The infected cells were subcultured until the amount of Core protein and the infectious titer in the culture supernatant reached 1,000 fmol/L and 1,000 ffu/ml or more, respectively. Infection with the culture supernatant containing the virus and subculture of infected cells were repeated 3 to 4 times and then sequence analysis was conducted for HCV RNA contained in the culture supernatant. Two infection lines were employed and designated as D3 and D4, respectively. First, RNA was extracted from each culture supernatant of Huh-7 cells containing JFH-2.1 A2218S HCV particles of infection line D3 and D4 and then HCV RNA contained therein was amplified by RT-PCR. Random primers (6 mer, Takara Bio Inc.) were used for amplification. Amplification products were cloned into sequencing cloning vectors and then subjected to sequence analysis by a conventional method.

As a result, in the case of infection line D3, nucleotide substitutions causing amino acid substitutions at 7 positions: 1 position in the E2 region that is in the structural region (I→T at position 414); and 2 positions in the NS3 region (E→Q at position 1510 and R→Q at position 1617), 3 positions in the NS5A region (K→Q at position 2006, A→V at position 2233, and N→S at position 2234); and 1 position in the NS5B region (T→I at position 2695), that are in the nonstructural region, were found. Also, in the case of infection line D4, nucleotide substitutions causing amino acid substitutions at 9 positions: 1 position in E2 region that is in the structural region (V→G at position 387); and 1 position in the NS2 region (V→A at position 828), 2 positions in the NS3 region (R→Q at position 1225 and R→G at position 1283), 1 position in the NS4B region (V→A at position 1883), 3 positions in the NS5A region (S→A at position 2206, K→N at position 2279, and C→R at position 2441), and 2 positions in the NS5B region (T→I at position 2695) that are in the nonstructural region, were found.

Example 16

Evaluation of HCV Particle-Producing Capacity of Cells into which Mutant J6/JFH-2.1 A2217S HCV RNA has been Introduced HCV full-genome RNA (mutant HCV full-genome RNA) was prepared by techniques similar to those in Example 2 using the expression vectors constructed in Example 14, pJ6/JFH-2.1 A2217S, pJ6/JFH-2.1 A2217S(CS), pJ6/JFH-2.1 A2217S (LP), pJ6/JFH-2.1 A2217S (TI), pJ6/JFH-2.1 A2217S (AT), pJ6/JFH-2.1 A2217S (CS/LP), pJ6/JFH-2.1 A2217S(CS/TI), pJ6/JFH-2.1 A2217S (TI/LP), pJ6/JFH-2.1 A2217S(CS/TI/LP), pJ6/JFH-2.1 A2217S (AT/CS/TI/LP), pJ6/JFH-2.1 A2217S (TI/MT/MK/NT/IV/SG/TA), and pJ6/JFH-2.1 A2217S (AT/CS/TI/LP/MV/VG/IV/KR). Each of the thus obtained HCV full-genome RNAs was introduced into Huh7 cells by electroporation. Thereafter, while subculturing cells in medium (10% fetal calf serum-containing Dulbecco's modified Eagle's medium (DMEM)), HCV Core protein contained in the culture supernatant was quantified over time using an HCV antigen ELISA test kit (Ortho Clinical Diagnostics) to confirm the production of HCV particles (FIG. 12).

As a result, it was demonstrated that when the above amino acid mutations at 7 or 8 positions were independently introduced into the J6/JFH-2.1 A2217S genome sequence, the RNA was self-replicated efficiently in cells into which the RNA was introduced, and the virus was secreted into the culture supernatant within a short time after the initiation of replication.

Industrial Applicability

The HCV replicons according to the present invention prepared using the genome of HCV of genotype 2a isolated from a fulminant hepatitis C patient, replicon-replicating cells into which the HCV replicons are introduced, the method for producing infectious HCV particles in the culture cell system using the HCV replicons, and infectious HCV particles obtained by the method are useful as systems for evaluation of molecules inhibiting HCV replication and HCV infection. The present invention can provide HCV subgenomic replicon RNA and full-genomic replicon RNA having self-replication capacity that is significantly higher than that of HCV subgenomic replicon RNA obtained thus far. These replicon RNAs can be used particularly conveniently for screening for anti-HCV agents that inhibit HCV replication or studies for elucidating the HCV replication mechanism. Also, the HCV full-genomic replicon RNA of the present invention possesses HCV particle-producing capacity that is higher than that of HCV full-genomic replicon RNA obtained thus far, so that it can be used for constructing a system for efficiently producing HCV particles at a high level, with which HCV particles having infectivity can be prepared in vitro in large amounts. Also, the HCV replicons and infectious HCV particles according to the present invention are also useful for use as HCV vaccines or antigens for preparation of anti-HCV antibodies. The method for producing HCV viral particles using multiple mutant replicons according to the present invention is also very useful for in vitro production of HCV viral particles within a short time period.

Sequence Listing Free Text

SEQ ID NOS: 1, 2, 11-13 and 16-87 are synthetic DNAs.

SEQ ID NOS: 88-98 are synthetic polypeptides.

SEQUENCE LISTING (98 sequences)

SEQ ID NO: 1 - DNA, 10711 bp, Artificial Sequence
  synthetic DNA
gaattctaatacgactcactatagacccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcccaaacctcaaagaaaaaccaacagaaacaccaaccgtcgcccaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaaccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgataccatggcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccacaccaaagccgttcttccgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcgagccagctgtcggccccgtcgctgcgtgccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagt

SEQ ID NO: 2 - DNA, 10711 bp, Artificial Sequence
  synthetic DNA
gaattctaatacgactcactatagacccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcccaaacctcaaagaaaaaccaacagaaacaccaaccgtcgcccaatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagtttaaaccctctccctcccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtgcacatgctttacatgtgtttagtcgaggttaaaaaaacgtctaggccccccgaaccacggggacgtggttttcctttgaaaaacacgatgatactatggcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcgaccttgaaggggtcctcagggggaccggtgctttgccccaggggccacgttgttgggatcttccgggcagccatatgctctcggggcgtggccaagtccatagacttcatccccgttgagatgcttgacatcgtcacgcgctcccccacctttaccgacaacagcacgccaccggctgtgccccagacctatcaggttggatacctgcacgccccaaccggcagcgggaagagcaccaaggtccctgttgcatacgccgcccaggggtacaaagtactagtgctgaatccctcggtggcggccaccctggggttcggggcatacttggccaaggcacatggcatcaatcccaatattaggactggagtcaggactgtgacgactggggaggccatcacgtactccacgtatggcaagttcctcgccgatgggggctgtgcaggcggcgcctatgacatcatcatatgcgatgaatgccacgccacggacgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccacaccaaagccgttcttccgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcgagccagctgtcggccccgtcgctgcgtgccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgtctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagt

SEQ ID NO: 3 - DNA, 9686 bp, Hepatitis C virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcccaaacctcaaagaaaaaccaacagaaacaccaaccgtcgcccacaagacgtcaagtttccgggcggcggccagatcgttggcggagtatacttgctgccgcgcaggggccccaggttgggtgtgcgcgcggcaaggaaaacttcggagcggtcacagccccgtgggagacgccagcccatccccaaagatcggcgtcccactggcaagtcctggggaaaaccaggatacccttggcccttatatgggaacgaggggctcggctgggcaggatggctcctgtccccccagggctcccgtccctcttggggccccactgacccccggcgtaggtcgcgcaatgtgggtaaggtcatcgacaccctaacgtgcggcttcgccgacctcatggggtacatccccgtcgtaggcgccccgcttggcggtgtcgccagagctctcgcgcatggcgtgagggccctggaggacggggtcaactatgcaacagggaacttacccggttgccccttttctatcttcttgctggccctactgtcctgcatcaccactccggtctcagctgcccaggtgaaaaacaccagtgacatctacatggtgactaacgactgtcccaacagcagcatcacctggcagcttagggccgcagtcctccacgtccccggatgtgtcccgtgtgagaaagtggggaatacatctcagtgctggacgccggtctcacccaatgtggctgtgcagcaacccggcgccctcacgcggggcttgcggacgcacatcgatatcgttgtaatgtccgctacgctctgctccgccctctatgtgggggacctctgcggcggggtaatgctcgcagcycagatrttcatcgtctcgccgcaacaccattggttcgtgcaagagtgcaactgctccatctaccctggcaccatcaccggwcatcgtatggcatgggacatgatgatgaactggtcgcccacagctaccatgatcctggcgtacgcgacacgcgttcccgaggtcatcatagacatcattagcggggctcactggggtgtcatgttcggcctggcctacttctctatgcagggagcgtgggcgaaagtcgttgtcatcctcctgctggccgctggggtggacgcacrkrscaccttcgtcattggggsccaggttgcgcgcaccgccagcrgccttcatrgcttgttcaccgycggcgctmagcagaacatccagctkatcaactccaatggcagttggcacatcaaccgcactgccctgaactgyaatgactctttgaacaccggcttcctcgcgtccctgttctacaccaatcgcttcaactcgtcrggatgcccagaacgtctggcatcctgccgtaggattgaggccttcaggataggatggggccacttgcaatatgagcacaatgtcaccaattcagaggatatgagaccatactgctggcattatccacccaaaccttgtggtatagtccccgcgaggtctgtgtgtggcccggtgtactgtttcacacccagcccagtagtagtgggcacgaccgacaggcgtggagtgcccacttacacgtggggggagaatgagacggacgtcttcctactgaacagcacccggccaccgcaggggtcatggttcggctgtacgtggatgaactccactggcttcaccaagacttgtggcgcaccaccttgccgcattagagctgatttcaatgccagcacggacctgttgtgccccacggactgttttaggaaacaccctgacgccacttacatcaagtgtggctccgggccctggctcacgcccagatgcctggtcgactacccctacaggctctggcactacccctgcacagtcaactatagcatcttcaagataaggatgtacgtggggggggttgaacacaggcttacagctgcctgtaacttcacccgcggggatccttgcaacttggatgacagagacagaagtcaactgtcccccttgttgcactctaccacggagtgggccatcttgccctgcacttactctgacctgcccgccttgtcgaccggtctcctccacctccaccaaaacatcgtggacgtgcaatacatgtacggcctttcaccagccgtcacgaagtacatagtccggtgggagtgggtagtgctcttgttcctgctcttggcggacgccagggtctgtgcctgtgtatggatgctcatcctgctgggccaagccgaggcagccctagagaagctggttgttttgcacgccgcgagtgcggctggctgcaatggctttctatatttcatcatctttttcgtggctgcgtggtgcatcaagggtcgagtggtccccttggctacctattccctcatcggcctatggtccttcttcctactgctcctagcattgcctcaacaggcttatgcttatgatgcaactgtgcatggacaaataggcgtggccctgttggtgctgctcaccctctttacactcaccccggcatataagaccctcctgggccggtgtctgtggtggctgtgctatctcctgaccttgggagaggccctcgtccaggagtgggcaccctccatgcaggcgcgcggtggccgggatggcatcatatgggctgccaccatattctgcccgggtgtggtgtttgacataaccaagtggcttttggcgatacttggacctggttatctcctaagagatgctttgacacgcgtgccgtatttcgtcagagcccacgctctgctgagaatgtgcgccatggtgaagcacctcgtggggggtaagtacgtccagatggcgctattaacccttggtaggtggactggcacttacatctacgaccacctcgcccccatgtcggattgggctgccagcggcctgcgggacctggcggtcgctgtggaacctatcatcttcagtccgatggagaaaaaagtcatcgtatggggagcggagacagccgcgtgcggggacatcttgcacggacttcccgtgtctgctcggcttggtcgagagatccttcttggcccagctgacggctacacctctaaggggtggaagcttcttgcgcctatcactgcttatgcccagcagacacgaggtctcttgggcgccatagtggtgagcatgacaggccgtgacaaaacggaacaggccggggagatccaagtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttctagaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgatygactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttctagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgycaaaaggggtayargggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagaattcttttcctgggtagacggagtacagatccacaggtttgctcccacaccaaagccgttcttccgggatgaggtctcgttcagcgtggggctcaactcatttgtagtcgggtctcagcttccctgcgaccctgaacccgacgcggacgtgttgatgtccatgctaacagatccaggccatatcacggcagaggctgcagcgcggcgcttagcgcgggggtcacccccatctgaggcaagctcctcagcaagccagctgtcggccccgtcgctgcgtgccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaaraccccgacgccccccccaaggaagcgtcggacggkgaraytyartgaragcgccgkgggaaacatcctccaacagytggytwttaaaacctttggccagccccctycaarsggaggsccaracccccccacgggggsgggsgccgccggttccggsggtyaaacgccccctkatkarccgggtyctttggaracggattttgtttyctccawgcccccccttkagggggagsccggaracccaracctggaggttggscaggtaaagccccaaccccccccccaggggggggaggcggctcccgactcagactctgggtcgtggtctacctgctccgaggaggaggattccgccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaagggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccatacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcastcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctytgcagatcatgt

SEQ ID NO: 4 - DNA, 9683 bp, Hepatitis C virus
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcccaaacctcaaagaaaaaccaacagaaacaccaaccgtcgcccacaagacgtcaagtttccgggcggcggccagatcgttggcggagtatacttgctgccgcgcaggggccccaggttgggtgtgcgcgcggcaaggaaaacttcggagcggtcacagccccgtgggagacgccagcccatccccaaagatcggcgtcccactggcaagtcctggggaaaaccaggatacccttggcccttatatgggaacgaggggctcggctgggcaggatggctcctgtccccccagggctcccgtccctcttggggccccactgacccccggcgtaggtcgcgcaatgtgggtaaggtcatcgacaccctaacgtgcggcttcgccgacctcatggggtacatccccgtcgtaggcgccccgcttggcggtgtcgccagagctctcgcgcatggcgtgagggccctggaggacggggtcaactatgcaacagggaacttacccggttgccccttttctatcttcttgctggccctactgtcctgcatcaccactccggtctcagctgcccaggtgaaaaacaccagtgacatctacatggtgactaacgactgtcccaacagcagcatcacctggcagcttagggccgcagtcctccacgtccccggatgtgtcccgtgtgagaaagtggggaatacatctcagtgctggacgccggtctcacccaatgtggctgtgcagcaacccggcgccctcacgcggggcttgcggacgcacatcgatatcgttgtaatgtccgctacgctctgctccgctctctatgtgggggacctctgcggcggggtaatgctcgcggcccagatattcatcgtctcgccacaacaccactggttcgtgcaagagtgcaattgctccatctaccctggtaccatcactggtcaccgtatggcatgggacatgatgatgaactggtcgcccacagctaccatgatcctggcgtacgcgacacgtgttcccgaggtcatcatagacatcattagcggggctcactggggtgtcatgttcggcctggcctacttctctatgcagggagcgtgggcgaaggtcgttgtcatcctcctgctggccgctggggtggacgcacataccaacgtcattggggcccaggtggggcgcaccgccagtagccttaatagcttgttcaccgtcggcgctaagcagaacatccagctgatcaactccaatggcagttggcacatcaaccgcactgctctgaactgcaatgactctctgaacaccggcttcctcgcgtccctgttctacaccaatcgcttcaactcgtcgggatgcccagaacgtctggcatcctgccgtaggattgaggccttcaggataggatggggcactctgcaatatgagcacaatgtcaccaattcagaggatatgagaccatactgctggcattatccacccaaaccttgtggtatagtccccgcgaggtctgtgtgtggcccggtgtactgtttcacacccagcccagtagtagtgggcacgaccgacaggcgtggagtgcccacttacacgtggggggagaatgagacggacgtcttcctactgaacagcacccggccaccgcgggggtcatggttcggctgtacgtggatgaactccactggcttcaccaagacttgtggcgcaccaccttgccgcattagagctgatttcaatgccagcacggacctgttgtgccccacggactgttttaggaaacaccctgacgccacttacatcaagtgtggctccgggccctggctcacgcccagatgcctggtcgactacccctacaggctctggcactacccctgcacagtcaactatagcatcttcaagataaggatgtacgtggggggggttgaacacaggcttacagctgcctgtaacttcacccgcggggatccttgcaacttggatgacagagacagaagtcaactgtcccccttgttgcactctaccacggagtgggccatcttgccctgcacttactctgacctgcccgccttgtcgaccggtctcctccacctccaccaaaacatcgtggacgtgcaatacatgtacggcctttcaccagccgtcacgaagtacatagtccggtgggagtgggtagtgctcttgttcctgctcttggcggacgccagggtctgtgcctgtgtatggatgctcatcctgctgggccaagccgaggcagccctagagaagctggttgttttgcacgccgcgagtgcggctggctgcaatggctttctatatttcatcatctttttcgtggctgcgtggtgcatcaagggtcgagtggtccccttggctacctattccctcatcggcctatggtccttcttcctactgctcctagcattgcctcaacaggcttatgcttatgatgcaactgtgcatggacaaataggcgtggccctgttggtgctgctcaccctctttacactcaccccggcatataagaccctcctgggccggtgtctgtggtggctgtgctatctcctgaccttgggagaggccctcgtccaggagtgggcaccctccatgcaggcgcgcggtggccgggatggcatcatatgggctgccaccatattctgcccgggtgtggtgtttgacataaccaagtggcttttggcgatacttggacctggttatctcctaagagatgctttgacacgcgtgccgtatttcgtcagagcccacgctctgctgagaatgtgcgccatggtgaagcacctcgtggggggtaagtacgtccagatggcgctattaacccttggtaggtggactggcacttacatctacgaccacctcgcccccatgtcggattgggctgccagcggcctgcgggacctggcggtcgctgtggaacctatcatcttcagtccgatggagaaaaaagtcatcgtatggggagcggagacagccgcgtgcggggacatcttgcacggacttcccgtgtctgctcggcttggtcgagagatccttcttggcccagctgacggctacacctctaaggggtggaagcttcttgcgcctatcactgcttatgcccagcagacacgaggtctcttgggcgccatagtggtgagcatgacaggccgtgacaaaacggaacaggccggggagatccaagtcctgtccacggtcactcagaccttcctcggaactaccatctcaggggtcttatggaccgtctaccacggagctggcaacaagaccttagccggttcgcggggcccggtcacgcagatgtactccagtgccgagggagacttggtggggtggcccagtccccccgggaccaaatccatggagccgtgcacatgcggagcggtcgacctgtatctggtcacgcggaacgctgatgtcatcccggctcggagacgcggggacaagcggggagcgttgctctccccgagacctctctcgaccttgaaggggtcctcagggggaccggtgctttgccccaggggccacgttgttgggatcttccgggcagccatatgctctcggggcgtggccaagtccatagacttcatccccgttgagatgcttgacatcgtcacgcgctcccccacctttaccgacaacagcacgccaccggctgtgccccggacctatcaggttggatacctgcacgccccaaccggcagcgggaagagcaccaaggtccctgttgcatacgccgcccaggggtacaaagtactagtgctgaatccctcggtggcggccaccctggggttcggggcatacttggccaaggcacatggcatcaatcccaatattaggactggagtcaggactgtgacgactggggaggccatcacgtactccacgtatggcaagttcctcgccgatgggggctgtgcaggcggcgcctatgacatcatcatatgcgatgaatgccacgccacggacgctaccacccttctcggcatcggaacagttcttgaccaagcagaatcagctggggtcaggctaaccgtactggccacggccacgcctcccgggtcgataacaacccctcatcccaatatagaggaggtggccctcggacaggagggcgagatccccttctatgggaaggcgatccccctggctcacatcaagggagggaggcatttgatcttctgccactcaaagaagaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgtaccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcgtactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctytgcagatcatgt

SEQ ID NO: 5 - protein, 3034 aa, Hepatitis C virus
MSTNPKPQRKTNRNTNRRPQDVKFPGGGQIVGGVYLLPRRGPRLGVRAARKTSERSQPRGRRQPIPKDRRPTGKSWGKPGYPWPLYGNEGLGWAGWLLSPQGSRPSWGPTDPRRRSRNVGKVIDTLTCGFADLMGYIPVVGAPLGGVARALAHGVRALEDGVNYATGNLPGCPFSIFLLALLSCITTPVSAAQVKNTSDIYMVTNDCPNSSITWQLRAAVLHVPGCVPCEKVGNTSQCWTPVSPNVAVQQPGALTRGLRTHIDIVVMSATLCSALYVGDLCGGVMLADQMFIVSPQHHWFVQECNCSIYPGTITGHRMAWDMMMNWSPTATMILAYATRVPEVIIDIISGAHWGVMFGLAYFSMQGAWAKVVVILLLAAGVDARGTFVIGGQVARTASGLHGLFTAGAQQNIQLINSNGSWHINRTALNCNDSLNTGFLASLFYTNRFNSSGCPERLASCRRIEAFRIGWGHLQYEHNVTNSEDMRPYCWHYPPKPCGIVPARSVCGPVYCFTPSPVVVGTTDRRGVPTYTWGENETDVFLLNSTRPPQGSWFGCTWMNSTGFTKTCGAPPCRIRADFNASTDLLCPTDCFRKHPDATYIKCGSGPWLTPRCLVDYPYRLWHYPCTVNYSIFKIRMYVGGVEHRLTAACNFTRGDPCNLDDRDRSQLSPLLHSTTEWAILPCTYSDLPALSTGLLHLHQNIVDVQYMYGLSPAVTKYIVRWEWVVLLFLLLADARVCACVWMLILLGQAEAALEKLVVLHAASAAGCNGFLYFIIFFVAAWCIKGRVVPLATYSLIGLWSFFLLLLALPQQAYAYDATVHGQIGVALLVLLTLFTLTPAYKTLLGRCLWWLCYLLTLGEALVQEWAPSMQARGGRDGIIWAATIFCPGVVFDITKWLLAILGPGYLLRDALTRVPYFVRAHALLRMCAMVKHLVGGKYVQMALLTLGRWTGTYIYDHLAPMSDWAASGLRDLAVAVEPIIFSPMEKKVIVWGAETAACGDILHGLPVSARLGREILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRATCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGNILQQLAIKTFGQPPPSGGPDPPTGAGAAGSGGQTPPDEPGPLETDFVSSMPPLEGEPGDPDLEVGQVKPQPPPQGGEAAPDSDSGSWSTCSEEEDSAVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 6 - protein, 3034 aa, Hepatitis C virus
MSTNPKPQRKTNRNTNRRPQDVKFPGGGQIVGGVYLLPRRGPRLGVRAARKTSERSQPRGRRQPIPKDRRPTGKSWGKPGYPWPLYGSEGLGWAGWLLSPQGSRPSWGPTDPRRRSRNVGKVIDTLTCGFADLMGYIPVVGAPLGGVARALAHGVRALEDGVNYATGNLPGCPFSIFLLALLSCITTPVSAAQVKNTSDIYMVTNDCPNSSITWQLRAAVLHVPGCVPCEKVGNTSQCWTPVSPNVAVQQPGALTRGLRTHIDIVVMSATLCSALYVGDLCGGVMLAAQMFIVSPQHHWFVQECNCSIYPGTITGHRMAWDMMMNWSPTATMILAYATRVPEVIIDIISGAHWGVMFGLAYFSMQGAWAKVVVILLLAAGVDARGTFLIGGQVARTANGLHGLFTAGAQQNIQLINSNGSWHINRTALNCNDSLNTGFLASLFYTNRFNSSGCPERLASCRRIEAFRIGWGTLQYEHNVTNSEDMRPYCWHYPPKPCGIVPARSVCGPVYCFTPSPVVVGTTDRRGVPTYTWGENETDVFLLNSTRPPQGSWFGCTWMNSTGFTKTCGAPPCRIRADFNASTDLLCPTDCFRKHPDATYIKCGSGPWLTPRCLVDYPYRLWHYPCTVNYSIFKIRMYVGGVEHRLTAACNFTRGDPCNLDDRDRSQLSPLLHSTTEWAILPCTYSDLPALSTGLLHLHQNIVDVQYMYGLSPAVTKYIVRWEWVVLLFLLLADARVCACVWMLILLGQAEAALEKLVVLHAASAAGCNGFLYFIIFFVAAWCIKGRVVPLATYSLIGLWSFFLLLLALPQQAYAYDATVHGQIGVALLVLLTLFTLTPAYKTLLGRCLWWLCYLLTLGEALVQEWAPSMQARGGRDGIIWAATIFCPGVVFDITKWLLAILGPGYLLRDALTRVPYFVRAHALLRMCAMVKHLVGGKYVQMALLTLGRWTGTYIYDHLAPMSDWAASGLRDLAVAVEPIIFSPMEKKVIVWGAETAACGDILHGLPVSARLGREILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEMLDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRATCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGNILQQLAIKTFGQPPPSGGPDPPTGAGAAGSGGQTPPDEPVLLETDFVSSMPPLEGEPGDPNLEVGQVKPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 7 - DNA, 2439 bp, Hepatitis C virus
atgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgct

SEQ ID NO: 8 - DNA, 340 bp, Hepatitis C virus
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcacc

SEQ ID NO: 9 - DNA, 651 bp, Hepatitis C virus
tatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctcctt

SEQ ID NO: 10 - DNA, 6253 bp, Hepatitis C virus
gcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgtgccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 11 - DNA, 9683 bp, Artificial Sequence
  synthetic DNA
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgtgccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 12 - DNA, 9683 bp, Artificial Sequence
  synthetic DNA
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 13 - DNA, 9686 bp, Artificial Sequence
  synthetic DNA
acccgcccctaataggggcgacactccgccatgaatcactcccctgtgaggaactactgtcttcacgcagaaagcgtctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcatcatgagcacaaatcccaaacctcaaagaaaaaccaacagaaacaccaaccgtcgcccacaagacgtcaagtttccgggcggcggccagatcgttggcggagtatacttgctgccgcgcaggggccccaggttgggtgtgcgcgcggcaaggaaaacttcggagcggtcacagccccgtgggagacgccagcccatccccaaagatcggcgtcccactggcaagtcctggggaaaaccaggatacccttggcccttatatgggaacgaggggctcggctgggcaggatggctcctgtccccccagggctcccgtccctcttggggccccactgacccccggcgtaggtcgcgcaatgtgggtaaggtcatcgacaccctaacgtgcggcttcgccgacctcatggggtacatccccgtcgtaggcgccccgcttggcggtgtcgccagagctctcgcgcatggcgtgagggccctggaggacggggtcaactatgcaacagggaacttacccggttgccccttttctatcttcttgctggccctactgtcctgcatcaccactccggtctcagctgcccaggtgaaaaacaccagtgacatctacatggtgactaacgactgtcccaacagcagcatcacctggcagcttagggccgcagtcctccacgtccccggatgtgtcccgtgtgagaaagtggggaatacatctcagtgctggacgccggtctcacccaatgtggctgtgcagcaacccggcgccctcacgcggggcttgcggacgcacatcgatatcgttgtaatgtccgctacgctctgctccgctctctatgtgggggacctctgcggcggggtaatgctcgcggcccagatattcatcgtctcgccacaacaccactggttcgtgcaagagtgcaattgctccatctaccctggtaccatcactggtcaccgtatggcatgggacatgatgatgaactggtcgcccacagctaccatgatcctggcgtacgcgacacgtgttcccgaggtcatcatagacatcattagcggggctcactggggtgtcatgttcggcctggcctacttctctatgcagggagcgtgggcgaaggtcgttgtcatcctcctgctggccgctggggtggacgcacataccaacttcgtcattggggcccaggtggggcgcaccgccagtagccttaatagcttgttcaccgtcggcgctaagcagaacatccagctgatcaactccaatggcagttggcacatcaaccgcactgctctgaactgcaatgactctctgaacaccggcttcctcgcgtccctgttctacaccaatcgcttcaactcgtcgggatgcccagaacgtctggcatcctgccgtaggattgaggccttcaggataggatggggcactctgcaatatgagcacaatgtcaccaattcagaggatatgagaccatactgctggcattatccacccaaaccttgtggtatagtccccgcgaggtctgtgtgtggcccggtgtactgtttcacacccagcccagtagtagtgggcacgaccgacaggcgtggagtgcccacttacacgtggggggagaatgagacggacgtcttcctactgaacagcacccggccaccgcgggggtcatggttcggctgtacgtggatgaactccactggcttcaccaagacttgtggcgcaccaccttgccgcattagagctgatttcaatgccagcacggacctgttgtgccccacggactgttttaggaaacaccctgacgccacttacatcaagtgtggctccgggccctggctcacgcccagatgcctggtcgactacccctacaggctctggcactacccctgcacagtcaactatagcatcttcaagataaggatgtacgtggggggggttgaacacaggcttacagctgcctgtaacttcacccgcggggatccttgcaacttggatgacagagacagaagtcaactgtcccccttgttgcactctaccacggagtgggccatcttgccctgcacttactctgacctgcccgccttgtcgaccggtctcctccacctccaccaaaacatcgtggacgtgcaatacatgtacggcctttcaccagccgtcacgaagtacatagtccggtgggagtgggtagtgctcttgttcctgctcttggcggacgccagggtctgtgcctgtgtatggatgctcatcctgctgggccaagccgaggcagccctagagaagctggttgttttgcacgccgcgagtgcggctggctgcaatggctttctatatttcatcatctttttcgtggctgcgtggtgcatcaagggtcgagtggtccccttggctacctattccctcatcggcctatggtccttcttcctactgctcctagcattgcctcaacaggcttatgcttatgatgcaactgtgcatggacaaataggcgtggccctgttggtgctgctcaccctctttacactcaccccggcatataagaccctcctgggccggtgtctgtggtggctgtgctatctcctgaccttgggagaggccctcgtccaggagtgggcaccctccatgcaggcgcgcggtggccgggatggcatcatatgggctgccaccatattctgcccgggtgtggtgtttgacataaccaagtggcttttggcgatacttggacctggttatctcctaagagatgctttgacacgcgtgccgtatttcgtcagagcccacgctctgctgagaatgtgcgccatggtgaagcacctcgtggggggtaagtacgtccagatggcgctattaacccttggtaggtggactggcacttacatctacgaccacctcgcccccatgtcggattgggctgccagcggcctgcgggacctggcggtcgctgtggaacctatcatcttcagtccgatggagaaaaaagtcatcgtatggggagcggagacagccgcgtgcggggacatcttgcacggacttcccgtgtctgctcggcttggtcgagagatccttcttggcccagctgacggctacacctctaaggggtggaagcttcttgcgcctatcactgcttatgcccagcagacacgaggtctcttgggcgccatagtggtgagcatgacaggccgtgacaaaacggaacaggccggggagatccaagtcctgtccacggtcactcagaccttcctcggaactaccatctcaggggtcttatggaccgtctaccacggagctggcaacaagaccttagccggttcgcggggcccggtcacgcagatgtactccagtgccgagggagacttggtggggtggcccagtccccccgggaccaaatccatggagccgtgcacatgcggagcggtcgacctgtatctggtcacgcggaacgctgatgtcatcccggctcggagacgcggggacaagcggggagcgttgctctccccgagacctctctcgaccttgaaggggtcctcagggggaccggtgctttgccccaggggccacgttgttgggatcttccgggcagccatatgctctcggggcgtggccaagtccatagacttcatccccgttgagatgcttgacatcgtcacgcgctcccccacctttaccgacaacagcacgccaccggctgtgccccggacctatcaggttggatacctgcacgccccaaccggcagcgggaagagcaccaaggtccctgttgcatacgccgcccaggggtacaaagtactagtgctgaatccctcggtggcggccaccctggggttcggggcatacttggccaaggcacatggcatcaatcccaatattaggactggagtcaggactgtgacgactggggaggccatcacgtactccacgtatggcaagttcctcgccgatgggggctgtgcaggcggcgcctatgacatcatcatatgcgatgaatgccacgccacggacgctaccacccttctcggcatcggaacagttcttgaccaagcagaatcagctggggtcaggctaaccgtactggccacggccacgcctcccgggtcgataacaacccctcatcccaatatagaggaggtggccctcggacaggagggcgagatccccttctatgggaaggcgatccccctggctcacatcaagggagggaggcatttgatcttctgccactcaaagaagaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcgtactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctytgcagatcatgt

SEQ ID NO: 14 - protein, 2003 aa, Hepatitis C virus
APITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRATCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGNILQQLAIKTFGQPPPSGGPDPPTGAGAAGSGGQTPPDEPGPLETDFVSSMPPLEGEPGDPDLEVGQVKPQPPPQGGEAAPDSDSGSWSTCSEEEDSAVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 15 - protein, 2003 aa, Hepatitis C virus
APITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEMLDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRATCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGNILQQLAIKTFGQPPPSGGPDPPTGAGAAGSGGQTPPDEPVLLETDFVSSMPPLEGEPGDPNLEVGQVKPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 16 - DNA, 18 bp, Artificial Sequence
  synthetic DNA
taatacgactcactatag

SEQ ID NO: 17 - DNA, 20 bp, Artificial Sequence
  synthetic DNA
gcggctcacggacctttcac

SEQ ID NO: 18 - DNA, 20 bp, Artificial
  synthetic DNA
ccggaattctaatacgactc

SEQ ID NO: 19 - DNA, 30 bp, Artificial Sequence
  synthetic DNA
gggcgtgttgagatacgctctaagcctgac

SEQ ID NO: 20 - DNA, 20 bp, Artificial Sequence
  synthetic DNA
ctgcagcaagccttggatct

SEQ ID NO: 21 - DNA, 30 bp, Artificial Sequence
  synthetic DNA
ttagagcgtatctcaacacgcccggcctac

SEQ ID NO: 22 - DNA, 30 bp, Artificial Sequence
  synthetic DNA
agtcgggccagccacttccacatggcgtcc

SEQ ID NO: 23 - DNA, 30 bp, Artificial Sequence
  synthetic DNA
atgtggaagtggctggcccgactcaagcct

SEQ ID NO: 24 - DNA, 30 bp, Artificial Sequence
  synthetic DNA
cttgcatgcaattggcgatgtacttcgtcc

SEQ ID NO: 25 - DNA, 30 bp, Artificial Sequence
  synthetic DNA
gtacatcgccaattgcatgcaagctgacct

SEQ ID NO: 26 - DNA, 20 bp, Artificial Sequence
  synthetic DNA
tgggacgccatgtggaagtg

SEQ ID NO: 27 - DNA, 30 bp, Artificial Sequence
  synthetic DNA
tgatccccgtgtcaagcgccgcgccgcagt

SEQ ID NO: 28 - DNA, 20 bp, Artificial Sequence
  synthetic DNA
aaagttacctttttagccct

SEQ ID NO: 29 - DNA, 30 bp, Artificial Sequence
  synthetic DNA
cgcggcgcttgacacggggatcacctccat

SEQ ID NO: 30 - DNA, 30 bp, Artificial Sequence
  synthetic DNA
ggtgcaggtggaccgcagcgacggtgctga

SEQ ID NO: 31 - DNA, 30 bp, Artificial Sequence
  synthetic DNA
ccgtcgctgcggtccacctgcaccacccac

SEQ ID NO: 32 - DNA, 30 bp, Artificial Sequence
  synthetic DNA
taggtgttgctttgggtggtgcaggtggcc

SEQ ID NO: 33 - DNA, 30 bp, Artificial Sequence
  synthetic DNA
ctgcaccacccaaagcaacacctatgacgt

SEQ ID NO: 34 - DNA, 19 bp, Artificial Sequence
  synthetic DNA
tacttgatccccgagaaac

SEQ ID NO: 35 - DNA, 19 bp, Artificial Sequence
  synthetic DNA
tgggaattgtttctcgggg

SEQ ID NO: 36 - DNA, 30 bp, Artificial Sequence
  synthetic DNA
gcgttccaccagtgccacccacggcacggc

SEQ ID NO: 37 - DNA, 20 bp, Artificial Sequence
  synthetic DNA
ccacacggacttgatgtggt

SEQ ID NO: 38 - DNA, 30 bp, Artificial Sequence
  synthetic DNA
caagaccgccatctggagggtggcggcctc

SEQ ID NO: 39 - DNA, 30 bp, Artificial Sequence
  synthetic DNA
ggtggcactggtggaacgcagcgacggggc

SEQ ID NO: 40 - DNA, 30 bp, Artificial Sequence
  synthetic DNA
ttcagccctcagaaaacttggggcgccacc

SEQ ID NO: 41 - DNA, 30 bp, Artificial Sequence
  synthetic DNA
ggagtaggctagggagtaacaagcggggtc

SEQ ID NO: 42 - DNA, 30 bp, Artificial Sequence
  synthetic DNA
ttgttactccctagcctactcctactcttt

SEQ ID NO: 43 - DNA, 16 bp, Artificial Sequence
  synthetic DNA
aacagctatgaccatg

SEQ ID NO: 44 - DNA, 18 bp, Artificial Sequence
  synthetic DNA
cagcttgtccgggagggc

SEQ ID NO: 45 - DNA, 20 bp, Artificial Sequence
  synthetic DNA
agccatgaattgatagggga

SEQ ID NO: 46 - DNA, 30 bp, Artificial Sequence
  synthetic DNA
tgccgcgcaggggccccaggttgggtgtgc

SEQ ID NO: 47 - DNA, 30 bp, Artificial Sequence
  synthetic DNA
gagagctctggtgacgccgccgagcggggc

SEQ ID NO: 48 - DNA, 30 bp, Artificial Sequence
  synthetic DNA
ggcggcgtcaccagagctctcgcgcatggc

SEQ ID NO: 49 - DNA, 20 bp, Artificial Sequence
  synthetic DNA
gctccctgcatagagaagta

SEQ ID NO: 50 - DNA, 20 bp, Artificial Sequence
  synthetic DNA
acggactgttttaggaagca

SEQ ID NO: 51 - DNA, 18 bp, Artificial Sequence
  synthetic DNA
tcttgtcgcgccccgtca

SEQ ID NO: 52 - DNA, 20 bp, Artificial Sequence
  synthetic DNA
aatttcactcgtggggatcg

SEQ ID NO: 53 - DNA, 23 bp, Artificial Sequence
  synthetic DNA
tgaccttcttctccatcggactg

SEQ ID NO: 54 - DNA, 19 bp, Artificial Sequence
  synthetic DNA
aagtgtgacgagctcgcgg

SEQ ID NO: 55 - DNA, 20 bp, Artificial Sequence
  synthetic DNA
tatgacatggagcagcacac

SEQ ID NO: 56 - DNA, 27 bp, Artificial Sequence
  synthetic DNA
agagggttggacgtctccataatacca

SEQ ID NO: 57 - DNA, 30 bp, Artificial Sequence
  synthetic DNA
caggccgcgcccaggccggcaaggctggtg

SEQ ID NO: 58 - DNA, 30 bp, Artificial Sequence
  synthetic DNA
taagacctgcatgaacacctggcaggggac

SEQ ID NO: 59 - DNA, 28 bp, Artificial Sequence
  synthetic DNA
acatgatctgcagagagaccagttacgg

SEQ ID NO: 60 - DNA, 30 bp, Artificial Sequence
  synthetic DNA
ataccatctccagagttcttttcctgggta

SEQ ID NO: 61 - DNA, 21 bp, Artificial Sequence
  synthetic DNA
tacggcacctctctgcagtca

SEQ ID NO: 62 - DNA, 19 bp, Artificial Sequence
  synthetic DNA
aagtgtgacgagctcgcgg

SEQ ID NO: 63 - DNA, 20 bp, Artificial Sequence
  synthetic DNA
tatgacatggagcagcacac

SEQ ID NO: 64 - DNA, 27 bp, Artificial Sequence
  synthetic DNA
agagggttggacgtctccataatacca

SEQ ID NO: 65 - DNA, 30 bp, Artificial Sequence; identical to SEQ ID NO: 57
  synthetic DNA

SEQ ID NO: 66 - DNA, 20 bp, Artificial Sequence
  synthetic DNA
ctgtgaggaactactgtctt

SEQ ID NO: 67 - DNA, 18 bp, Artificial Sequence
  synthetic DNA
ccagtccacctgccaagg

SEQ ID NO: 68 - DNA, 20 bp, Artificial Sequence
  synthetic DNA
ttcacgcagaaagcgtctag

SEQ ID NO: 69 - DNA, 20 bp, Artificial Sequence
  synthetic DNA
tccacgatgttttggtggag

SEQ ID NO: 70 - DNA, 19 bp, Artificial Sequence
  synthetic DNA
ctgtggcatactacagagg

SEQ ID NO: 71 - DNA, 20 bp, Artificial Sequence
  synthetic DNA
ttctcgccagacatgatctt

SEQ ID NO: 72 - DNA, 27 bp, Artificial Sequence
  synthetic DNA
agagggttggacgtctccataatacca

SEQ ID NO: 73 - DNA, 20 bp, Artificial Sequence
  synthetic DNA
ttctcgccagacatgatctt

SEQ ID NO: 74 - DNA, 19 bp, Artificial Sequence
  synthetic DNA
aagtgtgacgagctcgcgg

SEQ ID NO: 75 - DNA, 20 bp, Artificial Sequence
  synthetic DNA
tatgacatggagcagcacac

SEQ ID NO: 76 - DNA, 27 bp, Artificial Sequence
  synthetic DNA
agagggttggacgtctccataatacca

SEQ ID NO: 77 - DNA, 30 bp, Artificial Sequence; identical to SEQ ID NO: 57
  synthetic DNA

SEQ ID NO: 78 - DNA, 9683 bp, Artificial Sequence
  synthetic DNA: mutant chimeric HCV genome sequence J6/JFH-2.1 A2217S (CS)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccaccagtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 79 - DNA, 9683 bp, Artificial Sequence
  synthetic DNA: mutant chimeric HCV genome sequence J6/JFH-2.1 A2217S(LP)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccctagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 80 - DNA, 9683 bp, Artificial Sequence
  synthetic DNA: mutant chimeric HCV genome sequence J6/JFH-2.1 A2217S(TI)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccatacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 81 - DNA, 9683 bp, Artificial Sequence
  synthetic DNA: mutant chimeric HCV genome sequence J6/JFH-2.1 A2217S(CS/LP)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccaccagtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccacacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccctagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 82 - DNA, 9683 bp, Artificial Sequence
  synthetic DNA: mutant chimeric HCV genome sequence J6/JFH-2.1 A2217S(CS/TI)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccaccagtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccatacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 83 - DNA, 9683 bp, Artificial Sequence
  synthetic DNA: mutant chimeric HCV genome sequence J6/JFH-2.1 A2217S(TI/LP)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccatacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccctagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 84 - DNA, 9683 bp, Artificial Sequence
  synthetic DNA: mutant chimeric HCV genome sequence J6/JFH-2.1 A2217S(CS/TI/LP)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccaccagtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccatacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccctagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 85 - DNA, 9683 bp, Artificial Sequence
  synthetic DNA: mutant chimeric HCV genome sequence J6/JFH-2.1 A2217S(AT/CS/TI/LP)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcaccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccaccagtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccatacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccctagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 86 - DNA, 9683 bp, Artificial Sequence
  synthetic DNA: mutant chimeric HCV genome sequence J6/JFH-2.1 A2217S(TI/MT/MK/NT/IV/SG/TA)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcgccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcatgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacaagggccccaggcagaaaatccagctcgttaacaccactggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacagttaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccacgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcgcacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcatcggccgtttgcacgtcaaccagcgaaccgtcgttgcacctgacaaggaggtcctctatgaggcttttgacgagatggaggagtgtgcttccagagcggccctcgttgaggaggcgcaacggatagccgagatgctgaagtctaagatccaaggcttattgcagcaggcttccaagcaggcccaggacatacaaccaaccgtgcaggcttcatggcccaaggtggagcaattctgggccaaacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaggctcctcagcaagccagctgtcggccccgtcgctgcgttccacctgtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccatacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccttagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 87 - DNA, 9683 bp, Artificial Sequence
  synthetic DNA: mutant chimeric HCV genome sequence J6/JFH-2.1 A2217S(AT/CS/TI/LP/MV/VG/IV/KR)
acctgcccctaataggggcgacactccgccatgaatcactcccctgtgaggaactactgtcttcacgcagaaagcgcctagccatggcgttagtatgagtgtcgtacagcctccaggcccccccctcccgggagagccatagtggtctgcggaaccggtgagtacaccggaattgccgggaagactgggtcctttcttggataaacccactctatgcccggccatttgggcgtgcccccgcaagactgctagccgagtagcgttgggttgcgaaaggccttgtggtactgcctgatagggtgcttgcgagtgccccgggaggtctcgtagaccgtgcaccatgagcacaaatcctaaacctcaaagaaaaaccaaaagaaacaccaaccgtcgcccacaagacgttaagtttccgggcggcggccagatcgttggcggagtatacttgttgccgcgcaggggccccaggttgggtgtgcgcgcgacaaggaagacttcggagcggtcccagccacgtggaaggcgccagcccatccctaaagatcggcgctccactggcaaatcctggggaaaaccaggatacccctggcccctatacgggaatgagggactcggctgggcaggatggctcctgtccccccgaggttcccgtccctcttggggccccaatgacccccggcataggtcgcgcaacgtgggtaaggtcatcgataccctaacgtgcggctttgccgacctcatggggtacatccctgtcgtgggcgccccgctcggcggcgtcaccagagctctcgcgcatggcgtgagagtcctggaggacggggttaattttgcaacagggaacttacccggttgctccttttctatcttcttgctggccctgctgtcctgcatcaccaccccggtctccgctgccgaagtgaagaacatcagtaccggctacatggtgactaacgactgcaccaatgacagcattacctggcagctccaggctgctgtcctccacgtccccgggtgcgtcccgtgcgagaaagtggggaatgcatctcagtgctggataccggtctcaccgaatgtggccgtgcagcggcccggcgccctcacgcagggcttgcggacgcacatcgacatggttgtgatgtccgccacgctctgctctgccctctacgtgggggacctctgcggtggggtgatgctcgcagcccaaatgttcattgtctcgccgcagcaccactggtttgtccaagactgcaattgctccatctaccctggtaccatcactggacaccgcatggcatgggacatgatgatgaactggtcgcccacggctaccatgatcttggcgtacgcgatgcgtgtccccgaggtcattatagacatcattagcggggctcattggggcgtcgtgttcggcttggcctacttctctatgcagggagcgtgggcgaaagtcgttgtcatccttctgttggccgccggggtggacgcgcgcacccatactgttgggggttctgccgcgcagaccaccgggcgcctcaccagcttatttgacatgggccccaggcagaaaatccagctcgttaacaccaatggcagctggcacatcaaccgcaccgccctgaactgcaatgactccttgcacaccggctttatcgcgtctctgttctacacccacagcttcaactcgtcaggatgtcccgaacgcatgtccgcctgccgcagtatcgaggccttccgggtgggatggggcgccttgcaatatgaggataatgtcaccaatccagaggatatgagaccctattgctggcactacccaccaaggcagtgtggcgtggtctccgcgaagactgtgtgtggcccagtgtactgtttcacccccagcccagtggtagtgggcacgaccgacaggcttggagcgcccacttacacgtggggggagaatgagacagatgtcttcctattgaacagcactcgaccaccgctggggtcatggttcggctgcacgtggatgaactcttctggctacaccaagacttgcggcgcaccaccctgccgtactagagctgacttcaacgccagcacggacctgttgtgccccacggactgttttaggaagcatcctgataccacttacctcaaatgcggctctgggccctggctcacgccaaggtgcctgatcgactacccctacaggctctggcattacccctgcacaggtaactataccatcttcaaaataaggatgtatgtgggaggggttgagcacaggctcacggctgcatgcaatttcactcgtggggatcgttgcaacttggaggacagagacagaagtcaactgtctcctttgttgcactccaccacggaatgggccattttaccttgctcttactcggacctgcccgccttgtcgactggtcttctccacctccaccaaaacatcgtggacgtacaattcatgtatggcctatcacctgccctcacaaaatacatcgtccgatgggagtgggtaatactcttattcctgctcttagcggacgccagggtttgcgcctgcttatggatgctcatcttgttgggccaggccgaagcagcactagagaagctggtcatcttgcacgctgcgagcgcagctagctgcaatggcttcctatattttgtcatctttttcgtggctgcttggtacatcaagggtcgggtagtccccttagctacctattccctcactggcctgtggtcctttagcctactgctcctagcattgccccaacaggcttatgcttatgacgcatctgtgcatggccagataggagcggctctgctggtaatgatcaccctcttcacactcaccccggggtataagaccctcctcggccagtgtctgtggtggttgtgctatctcctgaccctgggggaagccatgattcaggagtgggtaccacccatgcaggtgcgcggcggccgcgatggcatcgcgtgggccgtcactatattctgcccgggtgtggtgtttgacattaccaaatggcttttggcgttgcttgggcctgcttacctcttaagggccgctttgacacatgtgccgtacttcgtcagagctcacgctctgataagggtatgcgctttggtgaagcagctcgcggggggtaggtatgttcaggtggcgctattggcccttggcaggtggactggcacctacatctatgaccacctcacacctatgtcggactgggccgctagcggcctgcgcgacttagcggtcgccgtggaacccatcatcttcagtccgatggagaagaaggtcatcgtctggggagcggagacggctgcatgtggggacattctacatggacttcccgtgtccgcccgactcggccaggagatcctcctcggcccagctgatggctacacctccaaggggtggaagctccttgcgcctatcactgcttatgcccagcagacacgaggcctattgggcgccatagtggtgagcatgacgggccgtgacaagacagaacaggccggggagatccaggtcctctccacagtcactcaaaccttcctcgggactaccatctcaggagtcttgtggaccgtctaccacggggctggcaacaagaccctagccggctcgcggggcccggtcacacagatgtactccagcgccgagggagacttggtagggtggcccagtcctcccgggactaaatccatggagccgtgcacgtgcggagcggtcgacctgtacctggtcacgcggaacgctgacgtcatcccggctcggagacgcggggacaagcggggagcgttgctctccccgagacctctctcaactctgaaggggtcttcggggggaccggtgctctgccccaggggccacgttgtcgggatcttccgggcagccatatgctcgcggggcgtggccaagtccatagatttcatccccgttgaggcaattgacatcgtcacgcgctcccccacctttactgacaacagcacgccaccggctgtgccccagacctatcaggttggatacttgcacgccccgactggcagcgggaagagcaccaaagtccctgtcgcatatgccgcccaggggtataaggtgctagtgctcaatccctcggtggccgccaccttggggtttggggcgtacttggccaaggcgcacggcatcaatcctaacattaggactggagtcaggactgtgacgaccggggaggctattacgtattccacgtatggcaagtttctcgctgatgggggctgcgcaggcggcgcctatgacatcatcatatgcgatgagtgccatgccacggatgctaccacccttctcggcatcggaacagttcttgaccaagcagagtcagctggggtcaggctaactgtgctggccacggctacgcctcccggatcaataacaacccctcaccccaacatagaggaggtagctctcggacaggagggtgagatccccttctatgggagagcgatccccctggcccacatcaagggagggaggcacctgatcttctgccactcgaagaaaaagtgtgacgagctcgcggcggccctccgggccatgggcttgaacgctgtggcatactacagagggttggacgtctccataataccagctcaaggagacgtggtggttgtcgccactgacgccctcatgacagggtacactggagactttgactccgtgattgactgcaacgtagcggttactcaagtcgtggacttcagcttggaccccaccttcaccatatccacacaaaccgtcccccaagacgccgtctcacgcagccagcgccgggggcgcacgggcagagggagactgggcatttacaggtacgtttccactggtgagcgagcttcgggaatgtttgacagcgtaacgctctgcgagtgctacgatgcaggggctgcatggtatgatctcacaccagcggaaaccaccgtcaggcttagggcgtatttcaacacgcccggcctgcccgtgtgccaagaccacctcgagttttgggaggcagttttcaccggcctcacacacatagatgcccactacctttcccaaacaaagcaagcgggggagaatttcgcatacctgacagcctatcaggccacagtgtgtgccagagccaaagcccctcccccgtcttgggacgtcatgtggaagtgcctgactcgactcaaacccacgctcgtgggccccacacctctcctgtaccgcctgggttcagttaccaacgatgtcaccttcacacaccctgtgacaaagtacatcgctacttgcatgcaagctgacctcgaggtcatgaccagcacgtgggtcctagccgggggagtcctggctgccatcgccgcgtactgcttggcgactgggtgtgtttccatcgtcggccgtttgcacgtcaaccagcgaaccgtcgttgcacctgacaaggaggtcctctatgaggcttttgacgagatggaggagtgtgcttccagagcggccctcattgaggaggcgcaacggatagccgagatgctgaagtctaagatccaaggcttattgcagcaggcttccaagcaggcccaggacatacaaccaaccgtgcaggcttcatggcccaaggtggagcaattctgggccagacacatgtggaacttcattagcggcatccaatatcttgcgggactgtcaacgctgccagggaaccccgctgtggcctctatgatggcattcagtgccgccatcaccagtccgctgtcgactagcaccaccatccttctcaacatcatgggaggctggctggcgtctcaaattgcgccacccgcaggggccacaggcttcgtggtcagtggcctggtgggggctgccataggcagcgtaggcttgggtaaggtgctggtggacatcttggcagggtacggtgcgggcatttcgggggctctcgtcgcattcaagatcatgtctggcgagaagccctccatggaggatgtcatcaacctgctgcccggaatcctgtccccgggcgccctggtggtgggggtcatttgcgcggccattctgcgccgtcatgtgggaccgggggaaggtgcggtccaatggatgaataggcttattgcctttgcttccagaggaaaccacgtcgcccccacccactatgtgacggagtcagatgcgtcgcagcgcgtgacccaactacttggctctctcaccataactagcctgcttagaaggctccacaattggattactgaggactgccccaccccatgcaatggctcatggctccgcgatgtgtgggactgggtgtgcaccatcctgactgactttaaaaactggctgacctccaagttgttcccaaagctgcccggcctccccttcatctcttgccaaaaggggtataggggcgactgggccggcacgggcatcatggtcacgcggtgcccttgtggcgccaacatttctggcaatgtccgcttcggctctatgagaatcacagggcctaagacctgcatgaacacctggcaggggactttccctatcaactgctacacggagggccaatgcatgccgagacctgcgccaaactttaagaccgccatctggagggtggcggcctcagagtacgcggaggtgacgcggcacgggtcgtactcttacataacagggctgaccgctgacaatctgaaggttccctgccaaataccatctccagagttcttttcctgggtagacggagtacagatccacaggtttgctcccactccaaagccgttctttcgggatgaggtctcgttcagcgtggggctcaactcatttgtagtcgggtctcagcttccctgcgaccctgaacccgacgcggacgtgttgatgtccatgctaacagatcctggccatatcacggcagaggctgcagcgcggcgcttagcgcgggggtcacccccatctgaggcaagctcctcagcaagccagctgtcggccccgtcgctgcgttccaccagtgccacccacggcacggcctatgatgtggccatggtggatgctaacctgttcatgaagggggaagtgattcggatagagtccgattccaaagtggtcgttctggactctctcgacccactggccgaagaggtgagcgacgtcgaaccctctataccatcagagtacttgatccccaagaaacaattcccaccagccttgccggcctgggcgcggcctgactacaacccaccgcttgtggaatcgtggaggaagcctgactaccaaccacccactgtcgcgggctgtgctctccccccccccaagaagaccccgacgccccccccaaggaagcgtcggacggtgagactcagtgagagcgccgtgggagacatcctccaacagctggctattaagacctttggccagccccctccaagcggaggcccagacccccccacgggggcgggcgccgccggctccggcggtcagacgccccctgatgagccggctccttcggagacggattctgtctcctccatgcccccccttgagggggagcccggagacccagacctggagcttggccaggtagagccccaaccccccccccaggggggggaggcggctcccgactcagactctgggtcgtggtctacctgctccgaggaggaggattccaccgtgtgctgctccatgtcatactcctggaccggggcccttataactccttgcagccccgaagaggagaagttgccaatcaatcccctgagcaactcattgttgcgctaccacaacaaggtgtactgcactacatcaagaagtgcgtcactgagggccaaaaaggtaacttttgacaggatgcaagtactcgatgcccactatgactcagtcttaaaggacattaagctagcggcctccaaggtcagcgcaaggtccctcagcttggaggaggcgtgcaagctgaccccgccccactctgcgaggtccaaatatggatttggggctaaggaggtccgcagcttgtccgggagggccgtcaaccacatcaagtccgtgtggaaggacctcttggaagactcacaaacaccaatacctacaaccatcatggccaagaatgaggtgttctgcgtgaaccctgctaaggggggcaagaaagcagctcgcctcatcgtttaccccgaccttggtgtcagggtctgcgaaaagatggccctctatgatgttgcacaaaagcttcctcaggcggtgatgggggcctcctatgggttccagtactctcccgcccagcgggtggagtttctcttgaaagcgtgggcggacaagaaagaccctatgggtttttcgtatgatacccgatgctttgactcaactgtcactgagagagacataagaactgaggaggacatatacctgtcctgctccctacccgaggaggcccgcactgccatacactcgctgactgagagactttacgtgggagggcccatgttcaacagcaagggccagacctgcgggtacaggcgttgccgcgctagcggggtgctcaccactagcatggggaataccatcacatgctatgtaaaagccctagcggcctgcaaggccgcagggatagttgcacccacgatgctggtatgcggcgatgacttggttgtcatctcagaaagccaggggactgaggaggacgagcggaacctgagagccttcacggaggctatgaccaggtattctgcccctcctggtgacccccccagaccggaatacgacttggagctgataacatcctgctcctcaaatgtgtctgtggcacttggcccccggggcaaccgcagatactatctgaccagagaccccaccactccaatcgcccgggctgcctgggaaacagtcagacactcccctgtcaattcatggctgggaaacatcatccagtacgctccaaccatatgggttcgtatggtcctgatgacacatttctactccattctcatggcccaagacactctggaccagaaccttaactttgaaatgtatggagctgtgtactctgtaagtcccttggacctcccagccataattgaaaagctccatgggcttgacgctttctctctgcacacatactctcccaacgaactgacgcgagtggcttcagccctcagaaaacttggggcgccacccctcagagcgtggaagagccgggcgcgtgcagtcagagcgtccctcatctcccgtggagggagagcggccgtctgcggtcgatatctcttcaactgggcggtgaagaccaagctcaaactcactccattgccggaggcgcgccatctggatttatccagttggttcaccgtcggcgccggcgggggcgacatttatcacagcgtgtcgcgtgcccgaccccgcttgttactccctagcctactcctactctttgtaggagtaggccttttcctactccccgctcggtagagcggcacacattagctacactccatagctaactgttccattttttttttttttttttttttttttttttttttttttttttttttttttttttttttttttcttttccttcctttctttttcactttacttcattctttcctggtggctccatcttagccctagtcacggctagctgtgaaaggtccgtgagccgcatgactgcagagagtgccgtaactggtctctctgcagatcatgt

SEQ ID NO: 88 - protein, 3033 aa, Artificial Sequence
  synthetic polypeptide: precursor protein encoded by J6/JFH-2.1 A2217S
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTATHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 89 - protein, 3033 aa, Artificial Sequence
  synthetic polypeptide: precursor protein encoded by J6/JFH-2.1 A2217S(CS)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTSATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTATHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 90 - protein, 3033 aa, Artificial Sequence
  synthetic polypeptide: precursor protein encoded by J6/JFH-2.1 A2217S(LP)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTATHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLPSLLLLFVGVGLFLLPAR

SEQ ID NO: 91 - protein, 3033 aa, Artificial Sequence
  synthetic polypeptide: precursor protein encoded by J6/JFH-2.1 A2217S(TI)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 92 - protein, 3033 aa, Artificial Sequence
  synthetic polypeptide: precursor protein encoded by J6/JFH-2.1 A2217S(CS/LP)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTSATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTATHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLPSLLLLFVGVGLFLLPAR

SEQ ID NO: 93 - protein, 3033 aa, Artificial Sequence
  synthetic polypeptide: precursor protein encoded by J6/JFH-2.1 A2217S(CS/TI)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTSATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 94 - protein, 3033 aa, Artificial Sequence
  synthetic polypeptide: precursor protein encoded by J6/JFH-2.1 A2217S(TI/LP)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLPSLLLLFVGVGLFLLPAR

SEQ ID NO: 95 - protein, 3033 aa, Artificial Sequence
  synthetic polypeptide: precursor protein encoded by J6/JFH-2.1 A2217S(CS/TI/LP)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTSATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLPSLLLLFVGVGLFLLPAR

SEQ ID NO: 96 - protein, 3033 aa, Artificial Sequence
  synthetic polypeptide: precursor protein encoded by J6/JFH-2.1 A2217S(AT/CS/TI/LP)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVTRALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIIGRLHVNQRTVVAPDKEVLYEAFDEMEECASRAALIEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTSATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLPSLLLLFVGVGLFLLPAR

SEQ ID NO: 97 - protein, 3033 aa, Artificial Sequence
  synthetic polypeptide: precursor protein encoded by J6/JFH-2.1 A2217S(TI/MT/MK/NT/IV/SG/TA)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVARALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVMFGLAYFSMQGAWAKVVVILLLAAGVDARTHTVGGSAAQTTGRLTSLFDKGPRQKIQLVNTTGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTVNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPTQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFAHPVTKYIATCMQADLEVMTSTWVLAGGVLAAIAAYCLATGCVSIIGRLHVNQRTVVAPDKEVLYEAFDEMEECASRAALVEEAQRIAEMLKSKIQGLLQQASKQAQDIQPTVQASWPKVEQFWAKHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEAGSSASQLSAPSLRSTCATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLLSLLLLFVGVGLFLLPAR

SEQ ID NO: 98 - protein, 3033 aa, Artificial Sequence
  synthetic polypeptide: precursor protein encoded by J6/JFH-2.1 A2217S(AT/CS/TI/LP/MV/VG/IV/KR)
MSTNPKPQRKTKRNTNRRPQDVKFPGGGQIVGGVYLLPRRGPRLGVRATRKTSERSQPRGRRQPIPKDRRSTGKSWGKPGYPWPLYGNEGLGWAGWLLSPRGSRPSWGPNDPRHRSRNVGKVIDTLTCGFADLMGYIPVVGAPLGGVTRALAHGVRVLEDGVNFATGNLPGCSFSIFLLALLSCITTPVSAAEVKNISTGYMVTNDCTNDSITWQLQAAVLHVPGCVPCEKVGNASQCWIPVSPNVAVQRPGALTQGLRTHIDMVVMSATLCSALYVGDLCGGVMLAAQMFIVSPQHHWFVQDCNCSIYPGTITGHRMAWDMMMNWSPTATMILAYAMRVPEVIIDIISGAHWGVVFGLAYFSMQGAWAKVVVILLLAAGVDARTHTVGGSAAQTTGRLTSLFDMGPRQKIQLVNTNGSWHINRTALNCNDSLHTGFIASLFYTHSFNSSGCPERMSACRSIEAFRVGWGALQYEDNVTNPEDMRPYCWHYPPRQCGVVSAKTVCGPVYCFTPSPVVVGTTDRLGAPTYTWGENETDVFLLNSTRPPLGSWFGCTWMNSSGYTKTCGAPPCRTRADFNASTDLLCPTDCFRKHPDTTYLKCGSGPWLTPRCLIDYPYRLWHYPCTGNYTIFKIRMYVGGVEHRLTAACNFTRGDRCNLEDRDRSQLSPLLHSTTEWAILPCSYSDLPALSTGLLHLHQNIVDVQFMYGLSPALTKYIVRWEWVILLFLLLADARVCACLWMLILLGQAEAALEKLVILHAASAASCNGFLYFVIFFVAAWYIKGRVVPLATYSLTGLWSFSLLLLALPQQAYAYDASVHGQIGAALLVMITLFTLTPGYKTLLGQCLWWLCYLLTLGEAMIQEWVPPMQVRGGRDGIAWAVTIFCPGVVFDITKWLLALLGPAYLLRAALTHVPYFVRAHALIRVCALVKQLAGGRYVQVALLALGRWTGTYIYDHLTPMSDWAASGLRDLAVAVEPIIFSPMEKKVIVWGAETAACGDILHGLPVSARLGQEILLGPADGYTSKGWKLLAPITAYAQQTRGLLGAIVVSMTGRDKTEQAGEIQVLSTVTQTFLGTTISGVLWTVYHGAGNKTLAGSRGPVTQMYSSAEGDLVGWPSPPGTKSMEPCTCGAVDLYLVTRNADVIPARRRGDKRGALLSPRPLSTLKGSSGGPVLCPRGHVVGIFRAAICSRGVAKSIDFIPVEAIDIVTRSPTFTDNSTPPAVPQTYQVGYLHAPTGSGKSTKVPVAYAAQGYKVLVLNPSVAATLGFGAYLAKAHGINPNIRTGVRTVTTGEAITYSTYGKFLADGGCAGGAYDIIICDECHATDATTLLGIGTVLDQAESAGVRLTVLATATPPGSITTPHPNIEEVALGQEGEIPFYGRAIPLAHIKGGRHLIFCHSKKKCDELAAALRAMGLNAVAYYRGLDVSIIPAQGDVVVVATDALMTGYTGDFDSVIDCNVAVTQVVDFSLDPTFTISTQTVPQDAVSRSQRRGRTGRGRLGIYRYVSTGERASGMFDSVTLCECYDAGAAWYDLTPAETTVRLRAYFNTPGLPVCQDHLEFWEAVFTGLTHIDAHYLSQTKQAGENFAYLTAYQATVCARAKAPPPSWDVMWKCLTRLKPTLVGPTPLLYRLGSVTNDVTFTHPVTKYIATCMQADLEVMTSTWVLAGGVLAAIAAYCLATGCVSIVGRLHVNQRTVVAPDKEVLYEAFDEMEECASRAALIEEAQRIAEMLKSKIQGLLQQASKQAQDIQPTVQASWPKVEQFWARHMWNFISGIQYLAGLSTLPGNPAVASMMAFSAAITSPLSTSTTILLNIMGGWLASQIAPPAGATGFVVSGLVGAAIGSVGLGKVLVDILAGYGAGISGALVAFKIMSGEKPSMEDVINLLPGILSPGALVVGVICAAILRRHVGPGEGAVQWMNRLIAFASRGNHVAPTHYVTESDASQRVTQLLGSLTITSLLRRLHNWITEDCPTPCNGSWLRDVWDWVCTILTDFKNWLTSKLFPKLPGLPFISCQKGYRGDWAGTGIMVTRCPCGANISGNVRFGSMRITGPKTCMNTWQGTFPINCYTEGQCMPRPAPNFKTAIWRVAASEYAEVTRHGSYSYITGLTADNLKVPCQIPSPEFFSWVDGVQIHRFAPTPKPFFRDEVSFSVGLNSFVVGSQLPCDPEPDADVLMSMLTDPGHITAEAAARRLARGSPPSEASSSASQLSAPSLRSTSATHGTAYDVAMVDANLFMKGEVIRIESDSKVVVLDSLDPLAEEVSDVEPSIPSEYLIPKKQFPPALPAWARPDYNPPLVESWRKPDYQPPTVAGCALPPPKKTPTPPPRKRRTVRLSESAVGDILQQLAIKTFGQPPPSGGPDPPTGAGAAGSGGQTPPDEPAPSETDSVSSMPPLEGEPGDPDLELGQVEPQPPPQGGEAAPDSDSGSWSTCSEEEDSTVCCSMSYSWTGALITPCSPEEEKLPINPLSNSLLRYHNKVYCTTSRSASLRAKKVTFDRMQVLDAHYDSVLKDIKLAASKVSARSLSLEEACKLTPPHSARSKYGFGAKEVRSLSGRAVNHIKSVWKDLLEDSQTPIPTTIMAKNEVFCVNPAKGGKKAARLIVYPDLGVRVCEKMALYDVAQKLPQAVMGASYGFQYSPAQRVEFLLKAWADKKDPMGFSYDTRCFDSTVTERDIRTEEDIYLSCSLPEEARTAIHSLTERLYVGGPMFNSKGQTCGYRRCRASGVLTTSMGNTITCYVKALAACKAAGIVAPTMLVCGDDLVVISESQGTEEDERNLRAFTEAMTRYSAPPGDPPRPEYDLELITSCSSNVSVALGPRGNRRYYLTRDPTTPIARAAWETVRHSPVNSWLGNIIQYAPTIWVRMVLMTHFYSILMAQDTLDQNLNFEMYGAVYSVSPLDLPAIIEKLHGLDAFSLHTYSPNELTRVASALRKLGAPPLRAWKSRARAVRASLISRGGRAAVCGRYLFNWAVKTKLKLTPLPEARHLDLSSWFTVGAGGGDIYHSVSRARPRLLLPSLLLLFVGVGLFLLPAR

The invention claimed is:

1. An isolated nucleic acid comprising a 5' untranslated region, an NS3 protein coding region, an NS4A protein coding region, an NS4B protein coding region, an NS5A protein coding region, an NS5B protein coding region, and a 3' untranslated region of a hepatitis C virus genome, wherein the nucleic acid has nucleotide substitutions causing one or more amino acid substitutions selected from the group consisting of F1548L, C1615W, T1652N, A2196T, A2218S, H2223Q, Q2281 R, K2520N, and G2374S, as defined using the amino acid sequence shown in SEQ ID NO: 5 or 6 as a reference sequence, in the NS3 protein coding region, the NS5A protein coding region, or the NS5B protein coding region.

2. The isolated nucleic acid according to claim 1, which has at least a nucleotide substitution causing amino acid substitution A2218S in the NS5A protein coding region.

3. The isolated nucleic acid according to claim 1 or 2, which further comprises a Core protein coding region, an E1 protein coding region, an E2 protein coding region, a p7 protein coding region, and an NS2 protein coding region of a hepatitis C virus genome.

4. The isolated nucleic acid according to claim 3, consisting of the nucleotide sequence shown in SEQ ID NO: 12 or 13.

5. The isolated nucleic acid according to claim 1, further comprising a marker gene and/or an IRES sequence.

6. The isolated nucleic acid according to claim 1 or 2, which is a subgenomic replicon RNA.

7. The isolated nucleic acid according to claim 3, which is a full-genomic replicon RNA.

8. An isolated expression vector, wherein the nucleic acid according to claim 1 or 2 is operably ligated downstream of a promoter.

9. An isolated expression vector, wherein the nucleic acid according to claim 3 is operably ligated downstream of a promoter.

10. An isolated transformed cell, which is obtained by introducing the full-genomic replicon RNA according to claim 7.

11. An isolated hepatitis C virus particle, which is obtained by culturing the transformed cell according to claim 10.

12. An isolated transformed cell, which is obtained by introducing the expression vector according to claim 9.

13. The isolated nucleic acid according to claim 3, wherein the nucleic acid has a nucleotide substitution causing the amino acid substitution A2218S in the nucleotide sequence shown in SEQ ID NO: 3 or 4.

14. The isolated nucleic acid according to claim 3, wherein the nucleic acid further comprises nucleotide substitutions causing amino acid substitutions in the nucleotide sequence shown in SEQ ID NO: 12, and wherein the amino acid substitutions are:
  i) M405K, N417T, M868T, T1642A, I1722V, S2204G and T2695I, as defined using the amino acid sequence shown in SEQ ID NO: 88 as a reference sequence, or
  ii) A148T, T329S, M356V, V626G, I1687V, K1767R, C2219S, T2695I and L3016P, as defined using the amino acid sequence shown in SEQ ID NO: 88 as a reference sequence.

15. The isolated nucleic acid according to claim 14, wherein the nucleic acid comprises the nucleotide sequence shown in SEQ ID NO: 86 or 87.

16. An isolated expression vector comprising the isolated nucleic acid according to claim 14.

17. An isolated transformed cell, into which the isolated nucleic acid according to claim 14 has been introduced.

18. An isolated transformed cell, into which the isolated expression vector according to claim 16 has been introduced.

19. An isolated hepatitis C virus particle, which is obtained by culturing the transformed cell according to claim 17.

* * * * *